(12) United States Patent
Matsunami et al.

(10) Patent No.: US 12,163,950 B2
(45) Date of Patent: Dec. 10, 2024

(54) SYNTHETIC ODORANT RECEPTORS

(71) Applicant: Duke University, Durham, NC (US)

(72) Inventors: Hiroaki Matsunami, Durham, NC (US); Kentaro Ikegami, Durham, NC (US); Maira Nagai, Durham, NC (US); Claire De March, Durham, NC (US)

(73) Assignee: Duke University, Durham, NC (US)

( * ) Notice: Subject to any disclaimer, the term of this patent is extended or adjusted under 35 U.S.C. 154(b) by 75 days.

(21) Appl. No.: 17/255,811

(22) PCT Filed: Jun. 26, 2019

(86) PCT No.: PCT/US2019/039293
§ 371 (c)(1),
(2) Date: Dec. 23, 2020

(87) PCT Pub. No.: WO2020/006108
PCT Pub. Date: Jan. 2, 2020

(65) Prior Publication Data
US 2021/0223232 A1 Jul. 22, 2021

Related U.S. Application Data

(60) Provisional application No. 62/690,198, filed on Jun. 26, 2018.

(51) Int. Cl.
*C07K 14/72* (2006.01)
*G01N 33/50* (2006.01)
*G01N 33/68* (2006.01)

(52) U.S. Cl.
CPC ....... *G01N 33/5041* (2013.01); *C07K 14/723* (2013.01); *G01N 33/6803* (2013.01); *G01N 2333/726* (2013.01)

(58) Field of Classification Search
CPC ........... G01N 33/5041; G01N 33/6803; G01N 2333/726; C07K 14/723; C07K 14/705
See application file for complete search history.

(56) References Cited

U.S. PATENT DOCUMENTS

| | | | |
|---|---|---|---|
| 4,657,760 A | 4/1987 | Kung et al. | |
| 4,968,103 A | 11/1990 | McNab et al. | |
| 5,096,815 A | 3/1992 | Ladner et al. | |
| 5,198,346 A | 3/1993 | Ladner et al. | |
| 5,206,344 A | 4/1993 | Katre et al. | |
| 5,223,409 A | 6/1993 | Ladner et al. | |
| 5,225,212 A | 7/1993 | Martin et al. | |
| 5,631,169 A | 5/1997 | Lakowicz et al. | |
| 7,879,565 B2 | 2/2011 | Matsunami et al. | |
| 2010/0248390 A1* | 9/2010 | Matsunami | G01N 33/566 702/19 |

FOREIGN PATENT DOCUMENTS

| | | | | |
|---|---|---|---|---|
| WO | WO-0168805 A2 * | 9/2001 | ........... | C07K 14/705 |
| WO | WO-02079449 A2 * | 10/2002 | ............. | C07K 14/47 |
| WO | WO 2003/094088 | 11/2003 | | |
| WO | WO 2007/121512 | 11/2007 | | |
| WO | WO 2016/030378 | 3/2016 | | |
| WO | WO 2017/147323 | 8/2017 | | |
| WO | WO 2018/081657 | 5/2018 | | |

OTHER PUBLICATIONS

Adipietro et al., Functional evolution of mammalian odorant receptors. PLoS Genet. 2012;8(7):e1002821. 1-14.
Ballesteros et al., Analysis and refinement of criteria for predicting the structure and relative orientations of transmembranal helical domains. Biophys J. Apr. 1992;62(1):107-9.
Belloir et al., Biophysical and functional characterization of the human olfactory receptor OR1A1 expressed in a mammalian inducible cell line. Protein Expr Purif. Jan. 2017;129:31-43.
Ben-Bassat et al., Processing of the initiation methionine from proteins: properties of the *Escherichia coli* methionine aminopeptidase and its gene structure. J Bacteriol. Feb. 1987;169(2):751-7.
Bubnell et al., In Vitro Mutational and Bioinformatics Analysis of the M71 Odorant Receptor and Its Superfamily. PLoS One. Oct. 29, 2015;10(10):e0141712. 1-24.
Buck et al., A novel multigene family may encode odorant receptors: a molecular basis for odor recognition. Cell. Apr. 5, 1991;65(1):175-87.
Cadwell et al., Randomization of genes by PCR mutagenesis. PCR Methods Appl. Aug. 1992;2(1):28-33.
Caruthers et al., New chemical methods for synthesizing polynucleotides. Nucl. Acids Res. Symp. Ser., 1980; 7:215-23.
Charlier et al., Molecular Modelling of Odorant/Olfactory Receptor Complexes. Methods in Molecular Biology. 2013. vol 1003. 53-65.
Chow et al., Synthesis of oligodeoxyribonucleotides on silica gel support. Nucleic Acids Res. Jun. 25, 1981;9(12):2807-17.
Cowen et al., Hsp90 potentiates the rapid evolution of new traits: drug resistance in diverse fungi. Science. Sep. 30, 2005;309(5744):2185-9.

(Continued)

*Primary Examiner* — Kimberly Ballard
*Assistant Examiner* — Stacey N MacFarlane
(74) *Attorney, Agent, or Firm* — Casimir Jones, S.C.; Robert A. Goetz

(57) ABSTRACT

The present invention relates to novel synthetic odorant receptors capable of cell surface localization upon cellular expression. Specifically, the present invention provides synthetic odorant receptors having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family. Additionally, the present invention provides methods of use, methods of synthesis, and cell lines expressing one or more of such novel synthetic odorant receptors.

2 Claims, 90 Drawing Sheets

Specification includes a Sequence Listing.

(56) References Cited

OTHER PUBLICATIONS

Crea et al., Synthesis of oligonucleotides on cellulose by a phosphotriester method. Nucl. Acids Res., 1980; 9:2331-2348.
Cwirla et al., Peptides on phage: a vast library of peptides for identifying ligands. Proc. Natl. Acad. Sci. USA. 1990; 87: 6378-82.
Dalton et al., Co-opting the unfolded protein response to elicit olfactory receptor feedback. Cell. Oct. 10, 2013;155(2):321-32.
Denyer et al., HTS approaches to voltage-gated ion channel drug discovery. Drug Discov. Today. 1998; 3:323-332.
Devlin et al., Random peptide libraries: a source of specific protein binding molecules. Science. Jul. 27, 1990;249(4967):404-6.
Dey et al., Calreticulin chaperones regulate functional expression of vomeronasal type 2 pheromone receptors. Proc Natl Acad Sci U S A. Oct. 4, 2011;108(40):16651-6.
Dunham et al., Enhancement of the surface expression of G protein-coupled receptors. Trends Biotechnol. Sep. 2009;27(9):541-5.
Eckert et al., DNA polymerase fidelity and the polymerase chain reaction. PCR Methods Appl. Aug. 1991;1(1):17-24.
Evans et al., An engineered poliovirus chimaera elicits broadly reactive HIV-1 neutralizing antibodies. Nature 1989; 339:385-388.
Extended European Search Report for PCT/US2019/039293. Mailed Jun. 22, 2022. 14 pages.
Geithe et al., Structural determinants of a conserved enantiomer-selective carvone binding pocket in the human odorant receptor OR1A1. Cell Mol Life Sci. Nov. 2017;74(22):4209-4229.
Gimelbrant et al., Truncation releases olfactory receptors from the endoplasmic reticulum of heterologous cells. J Neurochem. Jun. 1999;72(6):2301-11.
Gonzalez et al., Cell-based assays and instrumentation for screening ion-channel targets. Drug Discov Today. Sep. 1999;4(9):431-439.
Hochuli et al., New metal chelate adsorbent selective for proteins and peptides containing neighbouring histidine residues. J Chromatogr. Dec. 18, 1987;411:177-84.
Huang et al., Vaccinia virus recombinants expressing an 11-kilodalton beta-galactosidase fusion protein incorporate active beta-galactosidase in virus particles. J Virol. Oct. 1988;62(10):3855-61.
Ike et al., Solid phase synthesis of polynucleotides. VIII. Synthesis of mixed oligodeoxyribonucleotides by the phosphotriester solid phase method. Nucleic Acids Res. Jan. 25, 1983;11(2):477-88.
Ikegami et al., Divergence from conserved residues underlies intracellular retention of mammalian odorant receptors. bioRxiv, Apr. 10, 2019, XP055894324. 1-34.
Ikegami et al., Structural instability and divergence from conserved residues underlie intracellular retention of mammalian odorant receptors. Proc Natl Acad Sci U S A. Feb. 11, 2020;117(6):2957-2967.
International Search Report & Written Opinion, International Patent Application No. PCT/US2019/039293, mailed Jan. 27, 2020, 19 pages.
Itakura et al., Chemical synthesis and application of oligonucleotides of mixed sequence. Recombinant DNA, Proceedings of the 3rd Cleveland Symposium on Macromolecules, Elsevier, Amsterdam, 1981. pp 273-289.
Itakura et al., Expression in *Escherichia coli* of a chemically synthesized gene for the hormone somatostatin. Science. Dec. 9, 1977;198(4321):1056-63.
Itakura et al., Synthesis and use of synthetic oligonucleotides. Annu Rev Biochem. 1984;53:323-56.
Jamet et al., In Vitro Mutational Analysis of the β2 Adrenergic Receptor, an In Vivo Surrogate Odorant Receptor. PLoS One. Oct. 29, 2015;10(10):e0141696. 1-28.
Janknecht et al., Rapid and efficient purification of native histidine-tagged protein expressed by recombinant vaccinia virus. Proc Natl Acad Sci U S A. Oct. 15, 1991;88(20):8972-6.
Kaiser et al., Efficient cell-free production of olfactory receptors: detergent optimization, structure, and ligand binding analyses. Proc Natl Acad Sci U S A. Oct. 14, 2008;105(41):15726-31.
Kiefer et al., Expression of an olfactory receptor in *Escherichia coli*: purification, reconstitution, and ligand binding. Biochemistry. Dec. 17, 1996;35(50):16077-84.

Laird et al., Evidence against the role of rhodopsin in rod outer segment binding to RPE cells. Invest Ophthalmol Vis Sci. Mar. 1988;29(3):419-28.
Lam. Application of combinatorial library methods in cancer research and drug discovery. Anticancer Drug Des. Apr. 1997;12(3):145-67.
Leung et al., A Method for Random Mutagenesis of a Defined DNA Segment Using a Modified Polymerase Chain Reaction. Technique A Journal of Methods in Cell and Molecular Biology. 1989. 1:11-15.
Li et al., Unfolding the mystery of olfactory receptor gene expression. Dev Cell. Oct. 28, 2013;27(2):128-129.
Lu et al., Endoplasmic reticulum retention, degradation, and aggregation of olfactory G-protein coupled receptors. Traffic. Jun. 2003;4(6):416-33.
Malnic et al., The human olfactory receptor gene family. Proc Natl Acad Sci U S A. Feb. 24, 2004;101(8):2584-9.
Man et al., Prediction of the odorant binding site of olfactory receptor proteins by human-mouse comparisons. Protein Sci. Jan. 2004;13(1):240-54.
March et al., Conserved Residues Control Activation of Mammalian G Protein-Coupled Odorant Receptors. J Am Chem Soc. Jul. 8, 2015;137(26):8611-8616.
March et al., G protein-coupled odorant receptors: From sequence to structure. Protein Sci. Sep. 2015;24(9):1543-8.
March et al., Odorant Receptor 7D4 Activation Dynamics. Angewandte Chemie. 2018; 130(17): 4644-4648.
Matteucci et al., The synthesis of oligodeoxypyrimidines on a polymer support. Tetrahedron Lett., 1980; 21:719-722.
McClintock et al., Functional expression of olfactory-adrenergic receptor chimeras and intracellular retention of heterologously expressed olfactory receptors. Brain Res Mol Brain Res. Sep. 1997;48(2):270-8.
McConnell et al., The cytosensor microphysiometer: biological applications of silicon technology. Science. Sep. 25, 1992;257(5078):1906-12.
Miller et al., N-terminal methionine-specific peptidase in *Salmonella typhimurium*. Proc Natl Acad Sci U S A. May 1987;84(9):2718-22.
Moore et al., Directed evolution of a para-nitrobenzyl esterase for aqueous-organic solvents. Nat Biotechnol. Apr. 1996;14(4):458-67.
Narang et al., DNA Synthesis. Tetrahedron Lett., 1983; vol. 39, No. 1. 3-22.
Nardelli et al., A chemically defined synthetic vaccine model for HIV-1. J Immunol. Feb. 1, 1992;148(3):914-20.
Neuhaus et al., A specific heat shock protein enhances the expression of mammalian olfactory receptor proteins. Chem Senses. Jun. 2006;31(5):445-52.
Niimura et al., Extreme expansion of the olfactory receptor gene repertoire in African elephants and evolutionary dynamics of orthologous gene groups in 13 placental mammals. Genome Res. Sep. 2014;24(9):1485-96.
Olender et al., Update on the olfactory receptor (OR) gene superfamily. Hum Genomics. Sep. 2008;3(1):87-97.
Parker et al., Targeted gene walking polymerase chain reaction. Nucleic Acids Res. Jun. 11, 1991;19(11):3055-60.
Porebski et al., Consensus protein design. Protein Eng Des Sel. Jul. 2016;29(7):245-51.
Posnett et al., A novel method for producing anti-peptide antibodies. Production of site-specific antibodies to the T cell antigen receptor beta-chain. J Biol Chem. Feb. 5, 1988;263(4):1719-25.
Roberge et al., A strategy for a convergent synthesis of N-linked glycopeptides on a solid support. Science. Jul. 14, 1995;269(5221):202-4.
Roberts et al., Directed evolution of a protein: selection of potent neutrophil elastase inhibitors displayed on M13 fusion phage. Proc Natl Acad Sci U S A. Mar. 15, 1992;89(6):2429-33.
Rutherford et al., Hsp90 as a capacitor for morphological evolution. Nature. Nov. 26, 1998;396(6709):336-42.
Saito et al., RTP family members induce functional expression of mammalian odorant receptors. Cell. Nov. 24, 2004;119(5):679-91.
Sarkar et al., Restriction-site PCR: a direct method of unknown sequence retrieval adjacent to a known locus by using universal primers. PCR Methods Appl. May 1993;2(4):318-22.

(56) References Cited

OTHER PUBLICATIONS

Schlienger et al., Human Immunodeficiency Virus Type 1 Major Neutralizing Determinant Exposed on Hepatitis B Surface Antigen Particles Is Highly Immunogenic in Primates. J. Viro. 1992; 66(4):2570-2576.
Schroeder et al., FLIPR: A new instrument for accurate, high throughput optical screening. J. Biomol. Screening. 1996; 1(2):75-80.
Scott et al., Searching for Peptide Ligands with an Epitope Library. Science. 1980; 249(4967):386-390.
Sharma et al., Olfactory receptor accessory proteins play crucial roles in receptor funciton and gene choice. eLife. 2017;6:e21895. 1-28.
Triglia et al., A procedure for in vitro amplification of DNA segments that lie outside the boundaries of known sequences. Nucleic Acids Res. Aug. 25, 1988;16(16):8186.
Wilson et al., The structure of an antigenic determinant in a protein. Cell. Jul. 1984;37(3):767-78.
Wu et al., Receptor-transporting protein 1 short (RTP1S) mediates translocation and activation of odorant receptors by acting through multiple steps. J Biol Chem. Jun. 22, 2012;287(26):22287-94.
Young et al., Different evolutionary processes shaped the mouse and human olfactory receptor gene families. Hum Mol Genet. Mar. 1, 2002;11(5):535-46.
Zhao et al., Optimization of DNA shuffling for high fidelity recombination. Nucleic Acids Res. Mar. 15, 1997;25(6):1307-8.
Zhuang et al., Evaluating cell-surface expression and measuring activation of mammalian odorant receptors in heterologous cells. Nat Protoc. 2008;3(9):1402-13.
Zuckermann et al., Discovery of nanomolar ligands for 7-transmembrane G-protein-coupled receptors from a diverse N-(substituted)glycine peptoid library. J Med Chem. Aug. 19, 1994;37(17):2678-85.

\* cited by examiner

FIG. 10C
FIG. 10D
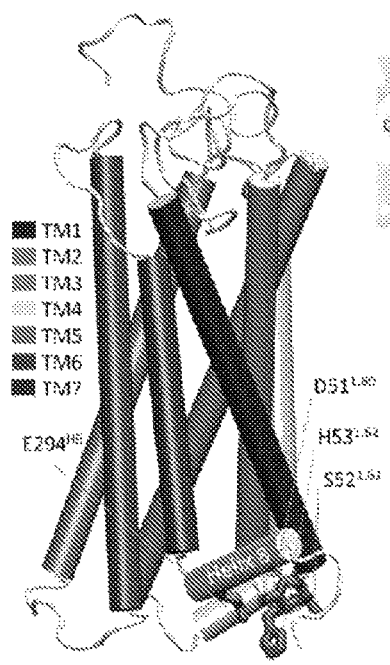
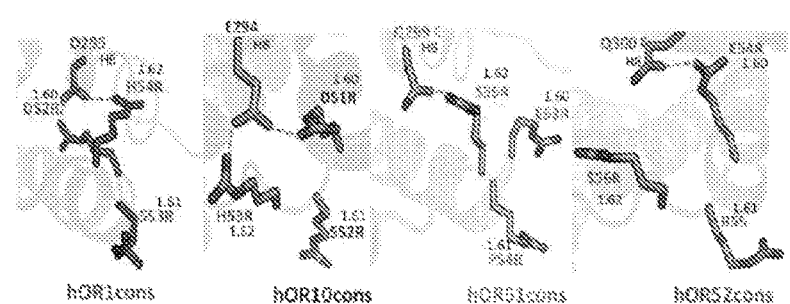
FIG. 10E
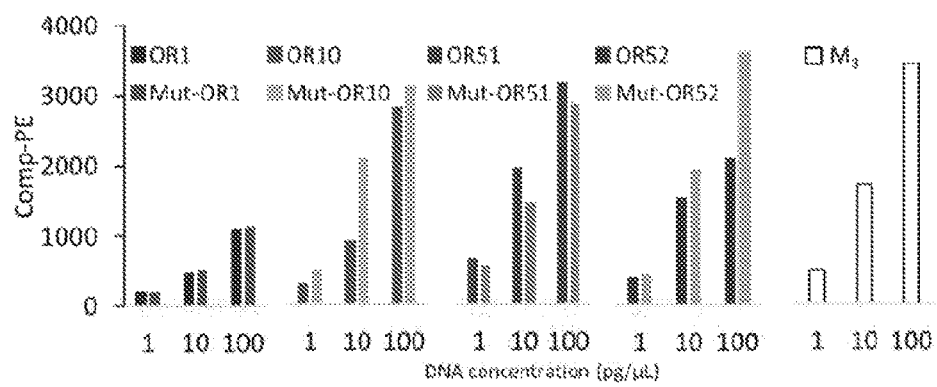
FIG. 10F
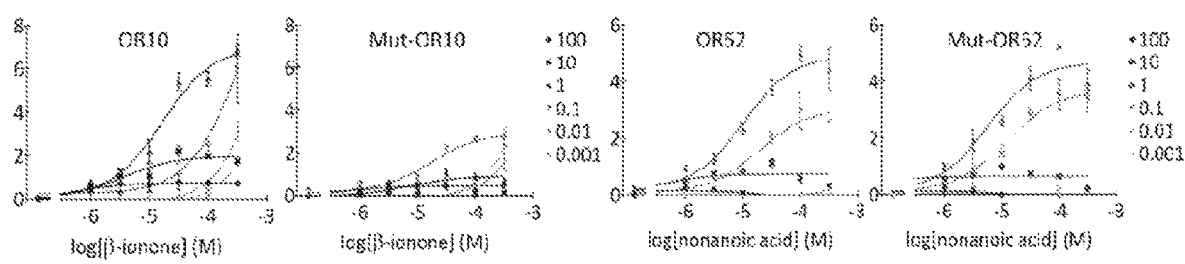

| SEQ ID NO: | | | | | | | | | | | | | | | |
|---|---|---|---|---|---|---|---|---|---|---|---|---|---|---|---|
| 3 | hOR1 | L | L | S | R | R | K | S | S | - | - | - | - | - | - |
| 4 | OR1F1 | V | V | G | R | V | V | F | S | V | - | - | - | - | - |
| 5 | OR1E1 | V | - | H | Q | K | K | T | F | F | S | L | - | - | - |
| 6 | OR1E2 | V | L | C | K | - | R | K | N | P | F | L | L | - | - |
| 7 | OR1J1 | L | L | S | - | - | - | - | - | - | - | - | - | - | - |
| 8 | OR1J2 | L | F | S | R | A | T | L | F | F | S | W | - | - | - |
| 9 | OR1J4 | L | F | N | R | A | T | S | V | L | S | Q | - | - | - |
| 10 | OR1N1 | L | F | S | H | R | S | K | L | V | S | S | - | - | - |
| 11 | OR1N2 | L | F | V | N | R | G | K | T | F | F | L | L | - | - |
| 12 | OR1M1 | L | V | N | R | K | - | L | T | S | S | S | - | - | - |
| 13 | OR1F12 | T | L | S | R | - | - | S | - | - | - | - | - | - | - |
| 14 | OR1L8 | L | M | S | K | R | S | - | C | Q | - | - | - | - | - |
| 15 | OR1L1 | L | M | H | R | M | K | K | C | Q | - | - | - | - | - |
| 16 | OR1L3 | L | N | H | R | M | K | S | Q | M | S | R | F | S T K T N K I | C G P |
| 17 | OR1L4 | L | R | H | R | R | Y | S | - | - | - | - | - | - | - |
| 18 | OR1L6 | L | Q | D | R | V | Y | R | - | H | S | P | - | - | - |
| 19 | OR1G1 | L | W | V | R | K | K | L | S | S | L | - | - | - | - |
| 20 | OR1S2 | L | N | N | R | K | K | S | S | L | - | - | - | - | - |
| 21 | OR1S1 | L | N | R | R | K | P | Q | R | P | K | - | - | - | - |
| 22 | OR1D5 | V | L | W | R | P | F | Q | R | P | K | - | - | - | - |
| 23 | OR1D4 | L | W | R | P | H | F | K | R | L | T | - | - | - | - |
| 24 | OR1D2 | L | L | D | K | K | R | S | S | - | - | - | - | - | - |
| 25 | OR1A2 | L | F | S | K | N | K | S | S | - | - | - | - | - | - |
| 26 | OR1A1 | L | F | N | K | K | A | V | P | C | P | R | - | - | - |
| 27 | OR1I1 | L | L | G | K | K | T | V | F | Q | Q | Q | - | - | P |
| 28 | OR1C1 | M | L | L | K | C | L | S | A | S | D | S | - | - | - |
| 29 | OR1K1 | L | L | G | R | R | T | F | F | R | - | - | - | - | - |
| 30 | OR1Q1 | W | M | S | R | M | Q | V | D | - | - | - | - | - | - |
| 31 | OR1B1 | L | L | E | W | V | K | - | - | - | - | - | - | - | P |

| SEQ ID NO: | | | | | | | | |
|---|---|---|---|---|---|---|---|---|
| 32 htOR8 | Q | F | S | - | - | - | - | - |
| 33 OR8B2 | Q | R | R | N | - | F | - | - |
| 34 OR8B3 | Q | R | R | N | - | - | - | - |
| 35 OR8B8 | A | F | S | - | - | - | - | - |
| 36 OR8B12 | - | F | S | - | - | - | - | - |
| 37 OR8A1 | L | - | - | - | - | - | - | - |
| 38 OR8D1 | - | - | - | - | - | - | - | - |
| 39 OR8D2 | Q | S | S | - | - | - | G | - |
| 40 OR8D4 | - | - | L | S | P | - | - | - |
| 41 OR8G5 | T | F | - | - | - | - | - | - |
| 42 OR8U1 | M | - | - | - | - | - | - | - |
| 43 OR8U8 | - | - | - | - | - | - | - | - |
| 44 OR8U9 | - | - | - | - | - | - | - | - |
| 45 OR8B4 | L | F | - | - | - | - | - | - |
| 46 OR8H2 | Q | D | D | R | - | R | - | - |
| 47 OR8H3 | Q | D | S | R | - | - | - | - |
| 48 OR8H1 | Q | D | S | R | - | - | - | - |
| 49 OR8I2 | L | F | P | - | - | - | - | - |
| 50 OR8I3 | C | Y | S | F | K | S | M | - |
| 51 OR8I1 | C | Y | - | - | - | T | M | - |
| 52 OR8K5 | - | - | - | - | K | - | - | - |
| 53 OR8K3 | C | N | - | N | Y | - | - | - |
| 54 OR8K1 | F | W | - | - | - | - | - | - |
| 55 OR8S1 | L | Q | Y | T | R | R | - | - |

SYNTHETIC ODORANT RECEPTORS

CROSS REFERENCE TO RELATED APPLICATIONS

This application is U.S. National Entry of International Patent Application No. PCT/US2019/039293, filed Jun. 26, 2019, which claims priority to and the benefit of U.S. Provisional Patent Application No. 62/690,198 filed Jun. 26, 2018, which are incorporated herein by reference in their entireties.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 1,000,000 Byte ASCII (Text) file named "36488-252_ST25," created on Feb. 8, 2021.

FIELD OF THE INVENTION

The present invention relates to novel synthetic odorant receptors capable of cell surface localization upon cellular expression. Specifically, the present invention provides synthetic odorant receptors having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family. Additionally, the present invention provides methods of use, methods of synthesis, and cell lines expressing one or more of such novel synthetic odorant receptors.

BACKGROUND OF THE INVENTION

G protein coupled receptors (GPCRs), also known as seven transmembrane pass receptors, are the largest superfamily of receptors. They are responsible for sensing a wide variety of stimuli including odorants, tastants, light, hormones, neurotransmitters and peptides. Mammalian olfactory receptors (ORs), which are a diverse family of rapidly evolving GPCRs (see, Buck, L. & Axel, R. Cell 65, 175-187 (1991); Niimura, Y., et al., Genome research 24, 1485-1496 (2014)), express on the cell surface of the olfactory sensory neurons (OSNs).

ORs are usually retained in the endoplasmic reticulum (ER) when expressed alone in non-olfactory cells including neurons (see, McClintock, T. S., et al. Brain Res Mol Brain Res 48, 270-278 (1997); Lu, M., Echeverri, F. & Moyer, B. D. Traffic 4, 416-433 (2003); Gimelbrant, A. A., et al., Journal of neurochemistry 72, 2301-2311 (1999). In developing OSNs, initiation of OR expression induce unfolded protein response (UPR), suggesting ER accumulation of ORs inefficient folding of ORs in these cells. Perk activation by UPR and subsequent inactivation accompanied with ER exit of ORs are crucial components of the feedback signals for stabilization of OR gene choice (see, Dalton, R. P., et al., Cell 155, 321-332 (2013); Li, Y. R. & Matsunami, H. Developmental cell 27, 128-129 (2013)).

Receptor transporting protein (RTP) 1 and RTP2, which enhance cell surface expression of ORs when co-transfected with ORs in heterologous cells (see, Saito, H., et al., Cell 119, 679-691 (2004); Zhuang, H. & Matsunami, H. Nature protocols 3, 1402-1413 (2008); Wu, L., et al., The Journal of biological chemistry 287, 22287-22294 (2012)), are induced by the UPR signaling in developing OSNs. Sustained UPR is observed in RTP1 and RTP2 double knockout mice (RTP DKO) (see, Sharma, R., et al. eLife 6 (2017)), suggesting that RTP1 and RTP2 downregulate UPR, presumably by allowing OR proteins to exit the ER. In the mutant olfactory epithelium, the majority of ORs are significantly underrepresented (uORs) due to the absence of mature OSNs expressing them, suggesting these ORs require RTP1 and RTP2 for their function (see, Sharma, R., et al. eLife 6 (2017)). Interestingly, a small subset of ORs is overrepresented (oORs), and OSNs expressing oORs do not show prolonged UPR in RTP DKO, suggesting that a minor subset of ORs function without RTP1 and RTP2. Accordingly, oORs show higher cell surface expression than uORs when expressed in heterologous cells (see, Sharma, R., et al. eLife 6 (2017)).

The underlying causes of OR retention in the ER and mechanism of RTP1 and RTP2 in facilitating OR trafficking are not well understood. Previous structure-functional analysis using model ORs based on the assumption of OR-specific ER retention signals did not identify common residues involved in cell surface expression of ORs (see, Gimelbrant, A. A., et al., Journal of neurochemistry 72, 2301-2311 (1999); Bubnell, J., et al. PloS one 10, e0141712 (2015); Jamet, S., et al. PloS one 10, e0141696 (2015)).

What is needed is a better understanding of odorant receptor trafficking.

The present invention addresses this need.

SUMMARY OF THE INVENTION

To approach the mechanistic understanding of OR trafficking, experiments conducted during the course of developing embodiments for the present invention took multiple complimentary strategies. First, experiments were conducted wherein a pair of closely related ORs that show differential cell surface expression in heterologous cells were used and the roles of specific amino acid residues that regulate cell surface expression determined. Second, experiments were conducted wherein molecular dynamic simulations using a set of ORs with differential cell surface expression were used to estimate protein stability. Third, a large-scale analysis for cell surface expression of ORs was conducted and the dataset used to determine critical amino acid residues that regulate cell surface expression. Fourth, ORs were synthesized and tested that have consensus residues. Together, such data indicated that divergence from conserved residues results in retention of ORs inside the cells, which may be caused by structural instability.

Accordingly, the present invention relates to novel synthetic odorant receptors capable of cell surface localization upon cellular expression. Specifically, the present invention provides synthetic odorant receptors having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family. Additionally, the present invention provides methods of use, methods of synthesis, and cell lines expressing one or more of such novel synthetic odorant receptors.

In certain embodiments, the present invention provides cell lines comprising recombinant cells which have been genetically engineered to express a functional synthetic odorant receptor, wherein the functional synthetic odorant receptor comprises a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family.

In some embodiments, the cell line comprises a heterologous nucleic acid encoding the functional synthetic odorant receptor.

In some embodiments, the odorant receptor family is selected from a human odorant receptor family or a murine odorant receptor family. In some embodiments, the odorant receptor family is a human odorant receptor family selected from human OR family 1, human OR family 2, human OR family 3, human OR family 4, human OR family 5, human OR family 6, human OR family 7, human OR family 8, human OR family 9, human OR family 10, human OR family 11, human OR family 12, human OR family 13, human OR family 14, human OR family 51, human OR family 52, human OR family 55, and human OR family 56. In some embodiments, the odorant receptor is a murine OR family selected from murine OR family 1, murine OR family 2, murine OR family 3, murine OR family 4, murine OR family 5, murine OR family 6, murine OR family 7, murine OR family 8, murine OR family 9, murine OR family 10-15, and murine OR family 16-34. In some embodiments, the odorant receptor family is mammalian odorant receptor family.

In some embodiments, the consensus amino acid sequence is selected from SEQ ID Nos: 56, 14, 144, 213, 93 and 117.

In some embodiments, the cell line is within an assay configured to detect and/or identify odorant receptor ligands.

In some embodiments, the cell line is within a device configured to detect and/or identify odorant receptor ligands.

In some embodiments, the cell line is configured for detecting and/or identifying odorants specific to the odorant receptor family related to the synthetic odorant receptor.

In some embodiments, the cell lines further comprise one or of RTP1, RTP2, and one or more additional functional synthetic odorant receptors, wherein each of the one or more functional synthetic odorant receptors comprise a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family.

In some embodiments, the cell line comprises a heterologous nucleic acid encoding the additional RTP1, RTP2, and one or more functional synthetic odorant receptor.

In some embodiments, the additional odorant receptor family is selected from a human odorant receptor family or a murine odorant receptor family. In some embodiments, the additional odorant receptor family is a human odorant receptor family selected from human OR family 1, human OR family 2, human OR family 3, human OR family 4, human OR family 5, human OR family 6, human OR family 7, human OR family 8, human OR family 9, human OR family 10, human OR family 11, human OR family 12, human OR family 13, human OR family 14, human OR family 51, human OR family 52, human OR family 55, and human OR family 56. In some embodiments, the odorant receptor is a murine OR family selected from murine OR family 1, murine OR family 2, murine OR family 3, murine OR family 4, murine OR family 5, murine OR family 6, murine OR family 7, murine OR family 8, murine OR family 9, murine OR family 10-15, and murine OR family 16-34. In some embodiments, the odorant receptor family is mammalian odorant receptor family.

In some embodiments, the cell line is within an assay configured to detect and/or identify odorant receptor ligands.

In some embodiments, the cell line is within a device configured to detect and/or identify odorant receptor ligands.

In some embodiments, the cell line is configured for detecting and/or identifying odorants specific to the odorant receptor family related to the synthetic odorant receptor.

In certain embodiments, the present invention provides methods for identifying an odorant receptor ligand, comprising a) providing i) a cell comprising recombinant cells which have been genetically engineered to express a functional synthetic odorant receptor, wherein the cell line comprises a heterologous nucleic acid encoding the functional synthetic odorant receptor, wherein the functional synthetic odorant receptor comprises a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family; ii) at least one test compound; b) exposing said test compound to said cell; and c) detecting the activity of said odorant receptor.

In some embodiments, the cell line comprises a heterologous nucleic acid encoding the functional synthetic odorant receptor.

In some embodiments, at least one test compound comprises more than one test compound. In some embodiments, the detecting comprises detecting a reporting agent. In some embodiments, the test compound is an odoriferous molecule. In some embodiments, the at least one test compound is exposed in the presence of a reference compound previously identified as a ligand for said odorant receptor. In some embodiments, the at least one test compound corresponds to a mixture of different test compounds.

In some embodiments, the methods further comprise the step of d) detecting the presence or absence of an odorant receptor ligand based upon said activity.

In some embodiments, the exposing said test compound to said cell occurs in a setting selected from the group consisting of an in vitro setting, an in vivo setting, an in vitro setting, and an ex vivo setting.

In some embodiments, the additional odorant receptor family is selected from a human odorant receptor family or a murine odorant receptor family. In some embodiments, the additional odorant receptor family is a human odorant receptor family selected from human OR family 1, human OR family 2, human OR family 3, human OR family 4, human OR family 5, human OR family 6, human OR family 7, human OR family 8, human OR family 9, human OR family 10, human OR family 11, human OR family 12, human OR family 13, human OR family 14, human OR family 51, human OR family 52, human OR family 55, and human OR family 56. In some embodiments, the odorant receptor is a murine OR family selected from murine OR family 1, murine OR family 2, murine OR family 3, murine OR family 4, murine OR family 5, murine OR family 6, murine OR family 7, murine OR family 8, murine OR family 9, murine OR family 10-15, and murine OR family 16-34. In some embodiments, the odorant receptor family is mammalian odorant receptor family.

In some embodiments, the consensus amino acid sequence is selected from SEQ ID Nos: 56, 14, 144, 213, 93 and 117.

In some embodiments, the cell is within an assay configured to detect and/or identify odorant receptor ligands. In some embodiments, the cell line is within a device configured to detect and/or identify odorant receptor ligands. In some embodiments, the cell line is configured for detecting and/or identifying odorants specific to the odorant receptor family related to the synthetic odorant receptor.

In some embodiments, the cell further comprises one or more of RTP1, RTP2, and one or more additional functional synthetic odorant receptors, wherein each of the one or more functional synthetic odorant receptors comprise a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family.

In some embodiments, the cell line comprises a heterologous nucleic acid encoding the RTP1, RTP2, and one or more functional synthetic odorant receptor.

In some embodiments, the additional odorant receptor family is selected from a human odorant receptor family or a murine odorant receptor family. In some embodiments, the additional odorant receptor family is a human odorant receptor family selected from human OR family 1, human OR family 2, human OR family 3, human OR family 4, human OR family 5, human OR family 6, human OR family 7, human OR family 8, human OR family 9, human OR family 10, human OR family 11, human OR family 12, human OR family 13, human OR family 14, human OR family 51, human OR family 52, human OR family 55, and human OR family 56. In some embodiments, the odorant receptor is a murine OR family selected from murine OR family 1, murine OR family 2, murine OR family 3, murine OR family 4, murine OR family 5, murine OR family 6, murine OR family 7, murine OR family 8, murine OR family 9, murine OR family 10-15, and murine OR family 16-34. In some embodiments, the odorant receptor family is mammalian odorant receptor family.

In some embodiments, the cell is configured for detecting and/or identifying odorants specific to the odorant receptor families related to the synthetic odorant receptors.

In certain embodiments, the present invention provides assays configured for detecting and/or identifying odorants comprising one or more cell lines described herein (e.g., cell lines comprising recombinant cells which have been genetically engineered to express a functional synthetic odorant receptor, wherein the functional synthetic odorant receptor comprises a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family).

In certain embodiments, the present invention provides cell lines expressing a functional odorant receptor, wherein the expressed odorant receptor is localized at the cell surface, wherein the cell line expresses a heterologous nucleic acid encoding a polypeptide comprising an amino acid sequence that is at least 80% identical to SEQ ID No: 2 (mutant form of olfr541) such that amino acid 154 of SEQ ID NO: 2 is G and amino acid 209 of SEQ ID NO: 2 is V.

In some embodiments, the odorant receptor is a murine odorant receptor. In some embodiments, the odorant receptor is a synthetic odorant receptor.

In some embodiments, the cell line expresses a heterologous nucleic acid encoding a polypeptide comprising an amino acid sequence that is at least 85% identical to SEQ ID No: 2 such that amino acid 154 of SEQ ID NO: 2 is G and amino acid 209 of SEQ ID NO: 2 is V. In some embodiments, the cell line expresses a heterologous nucleic acid encoding a polypeptide comprising an amino acid sequence that is at least 90% identical to SEQ ID No: 2 such that amino acid 154 of SEQ ID NO: 2 is G and amino acid 209 of SEQ ID NO: 2 is V. In some embodiments, the cell line expresses a heterologous nucleic acid encoding a polypeptide comprising an amino acid sequence that is at least 95% identical to SEQ ID No: 2 such that amino acid 154 of SEQ ID NO: 2 is G and amino acid 209 of SEQ ID NO: 2 is V. In some embodiments, the cell line expresses a heterologous nucleic acid encoding a polypeptide comprising an amino acid sequence that is at least 99% identical to SEQ ID No: 2 such that amino acid 154 of SEQ ID NO: 2 is G and amino acid 209 of SEQ ID NO: 2 is V.

In some embodiments, the cell line is within an assay configured to detect and/or identify odorant receptor ligands. In some embodiments, the cell line is within a device configured to detect and/or identify odorant receptor ligands. In some embodiments, the cell line is configured for detecting and/or identifying odorants specific to the odorant receptor family related to the synthetic odorant receptor.

In some embodiments, the methods further comprise heterologous nucleic acid encoding one or more additional RTP1, RTP2, and one or more functional synthetic odorant receptors, wherein each of the one or more functional synthetic odorant receptors comprise a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family.

In some embodiments, the cell line comprises a heterologous nucleic acid encoding the additional RTP1, RTP2, and one or more functional synthetic odorant receptor.

In some embodiments, the additional odorant receptor family is a human odorant receptor family selected from human OR family 1, human OR family 2, human OR family 3, human OR family 4, human OR family 5, human OR family 6, human OR family 7, human OR family 8, human OR family 9, human OR family 10, human OR family 11, human OR family 12, human OR family 13, human OR family 14, human OR family 51, human OR family 52, human OR family 55, and human OR family 56.

In some embodiments, the odorant receptor is a murine OR family selected from murine OR family 1, murine OR family 2, murine OR family 3, murine OR family 4, murine OR family 5, murine OR family 6, murine OR family 7, murine OR family 8, murine OR family 9, murine OR family 10-15, and murine OR family 16-34.

In some embodiments, the odorant receptor family is mammalian odorant receptor family.

In some embodiments, the cell line is configured for detecting and/or identifying odorants specific to the odorant receptor families related to the synthetic odorant receptors.

In some embodiments, the consensus amino acid sequence is selected from SEQ ID Nos: 56, 14, 144, 213, 93 and 117.

These and other novel features and advantages of the disclosure will be fully understood from the following detailed description and the accompanying drawings.

Figure 11:
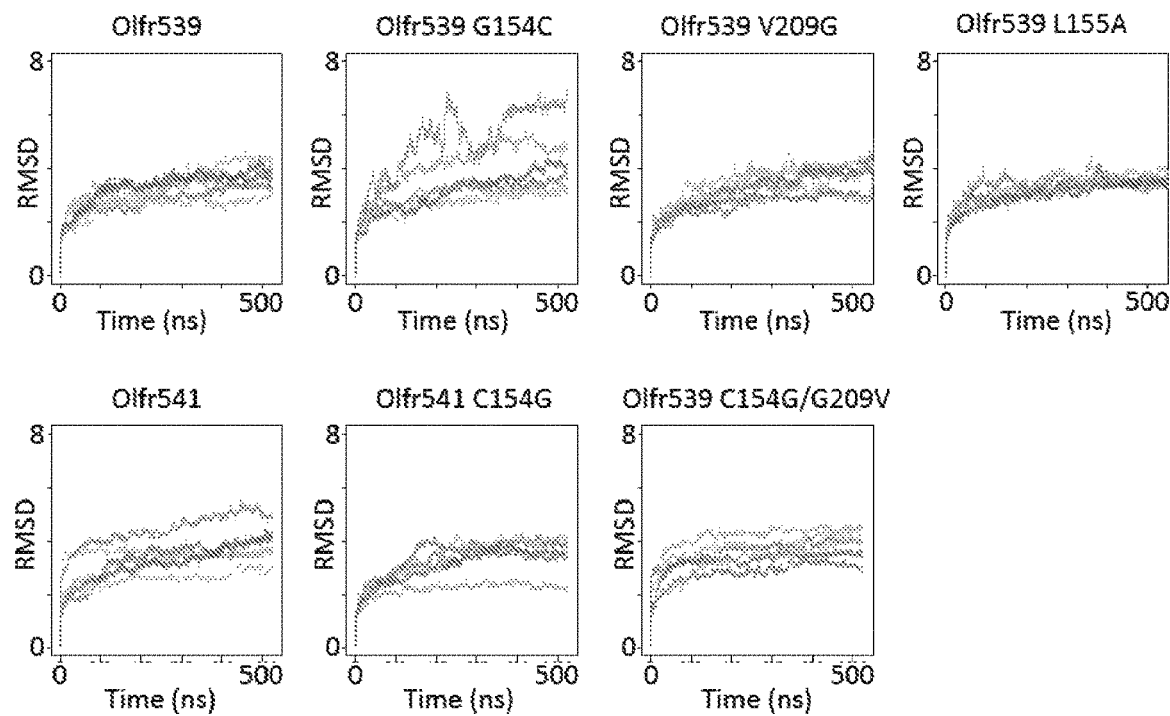

FIG. 11. RMSDs of six individual simulations of Olfr539 and Olfr539 G154C. Both RTP-independent ORs (left) and RTP-dependent ORs (right) are distributed on multi branches of the phylogenetic tree based on protein sequences of ORs. Both tested oORs (left) and tested uORs (right) are distributed on multi branches of the phylogenetic tree based on protein sequences of ORs.

Figure 12:
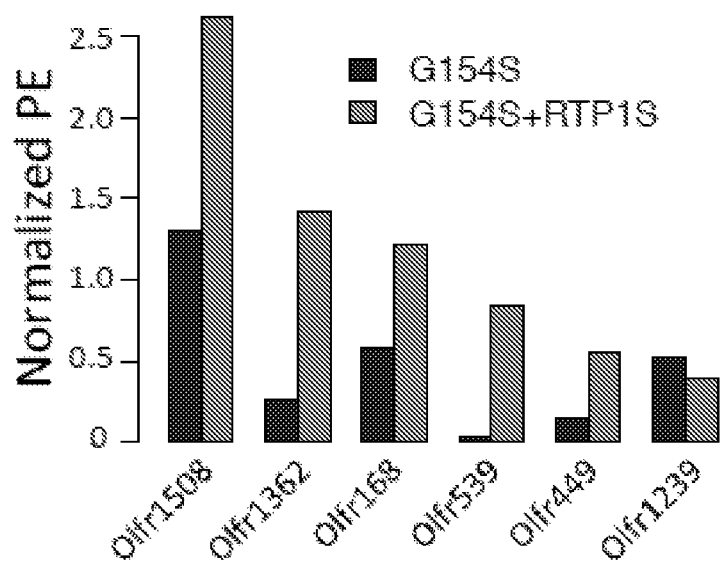

FIG. 12. RTP1S enhances cell surface expression of wild types of RTP-independent ORs.

Figure 13:
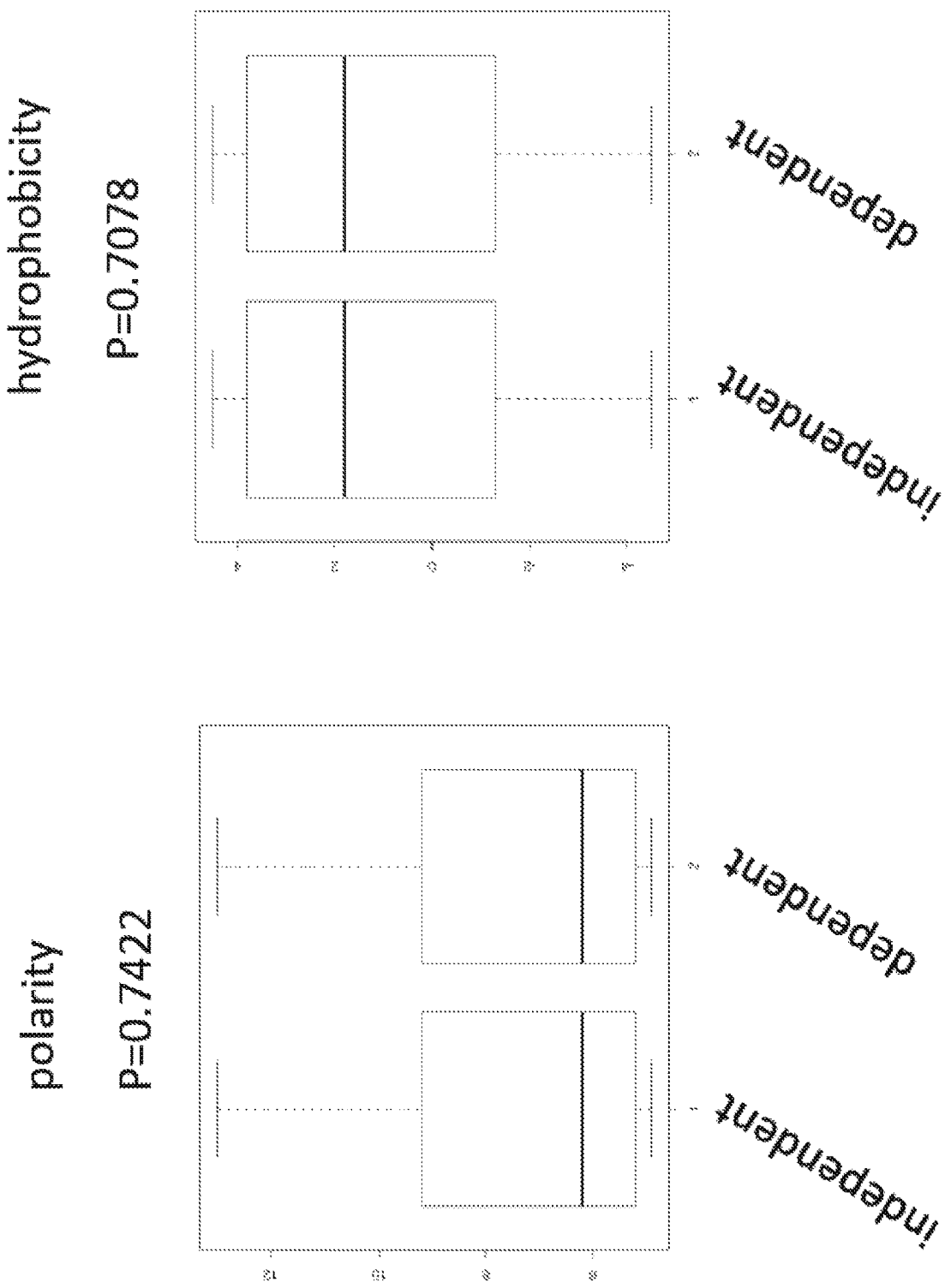
Figure 20:
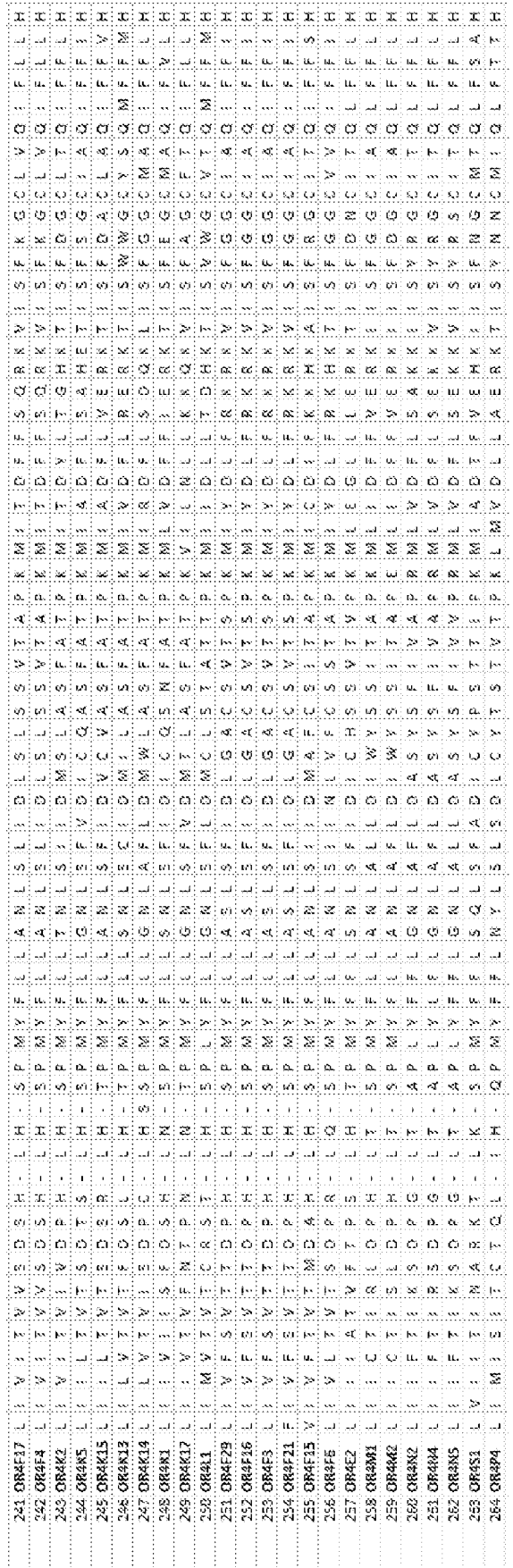

FIG. 13. Amino acids of RTP-independent ORs and RTP-dependent ORs are not statistically different in their polarity and hydrophobicity (p=0.74 and p=0.71, respectively).

Figure 14:
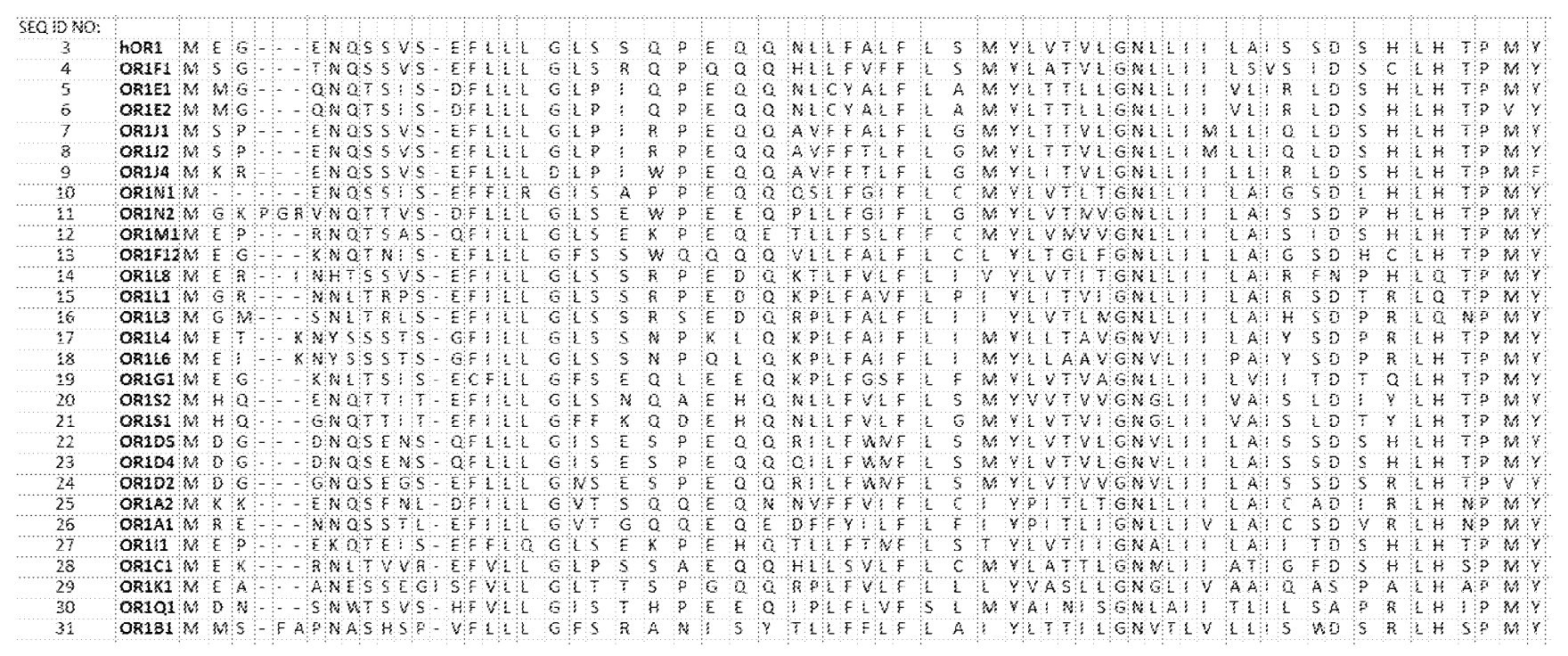
Figure 14:
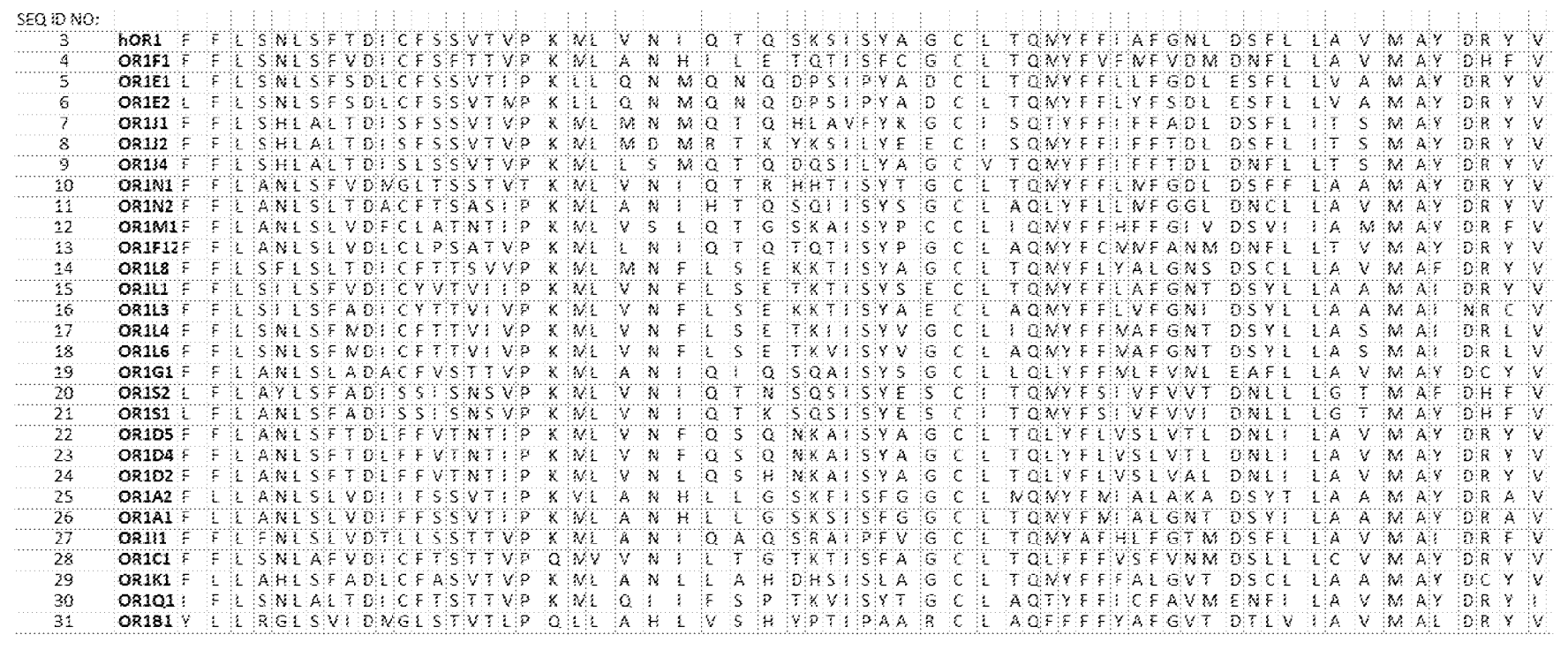
Figure 14:
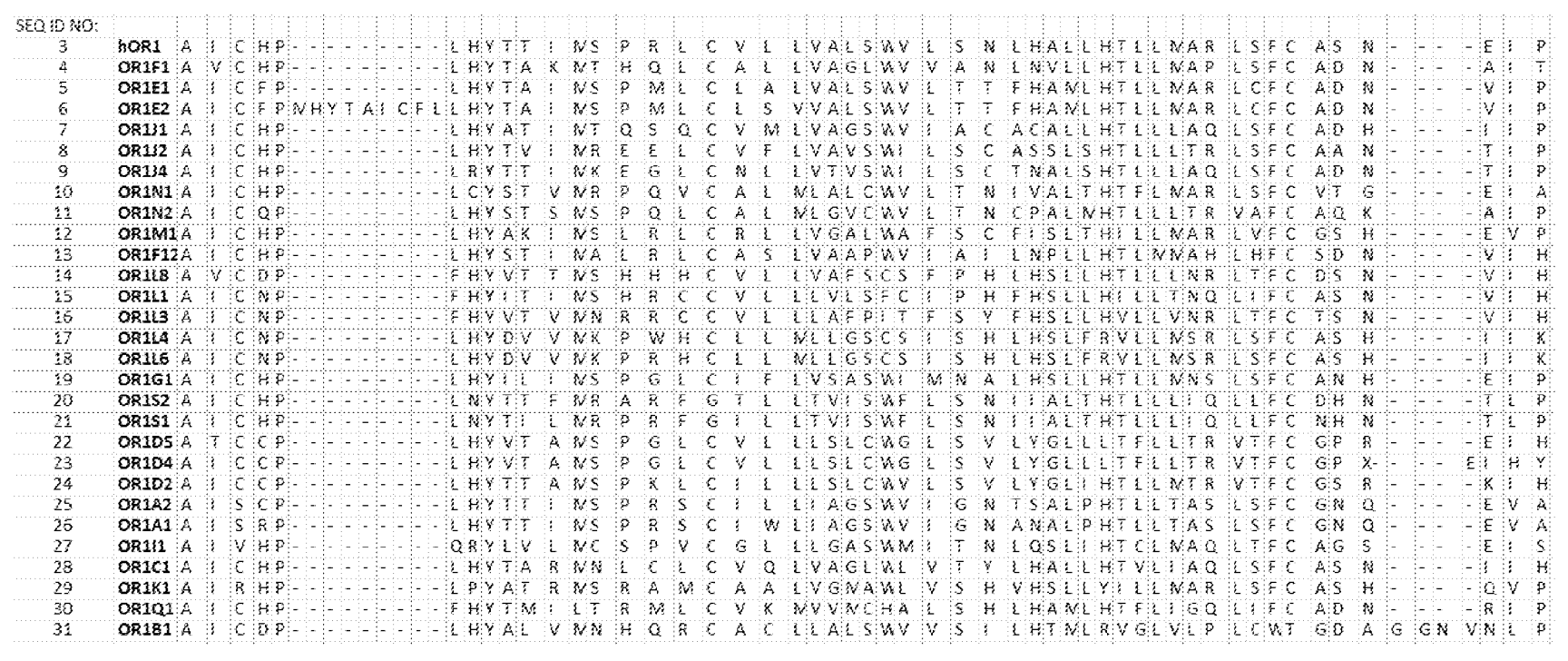
Figure 14:
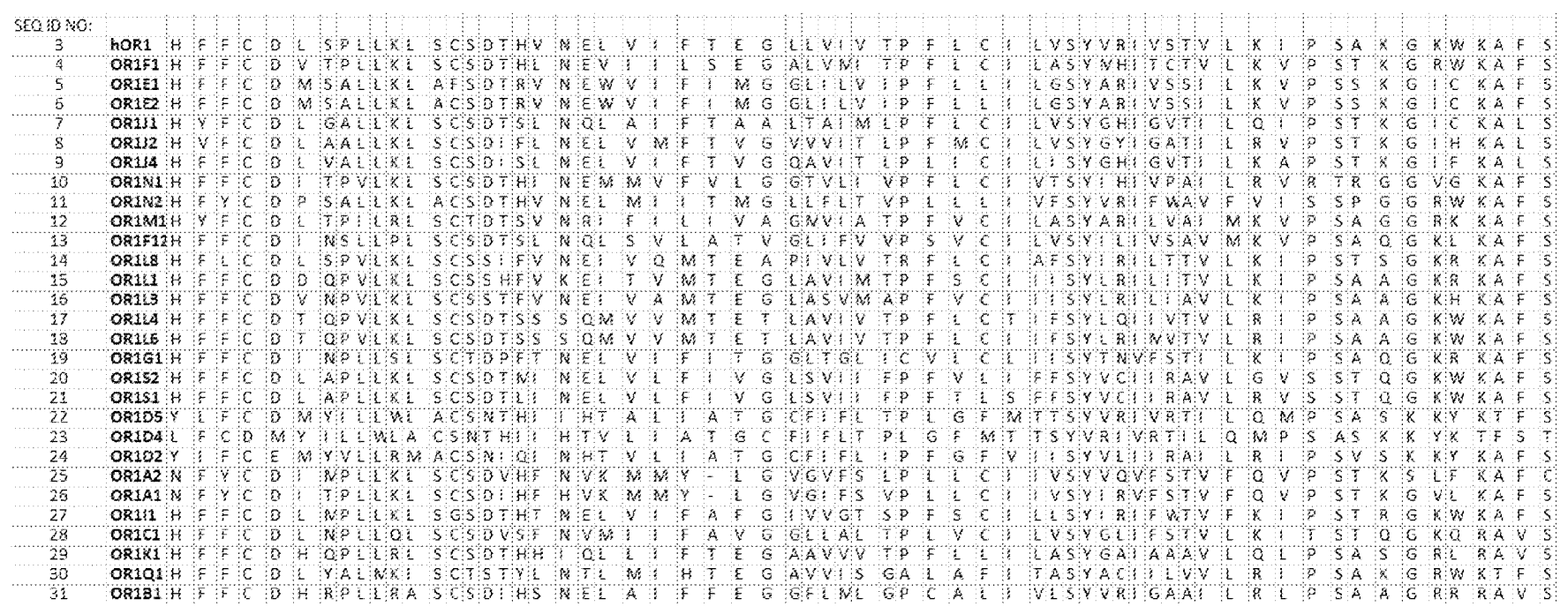
Figure 14:
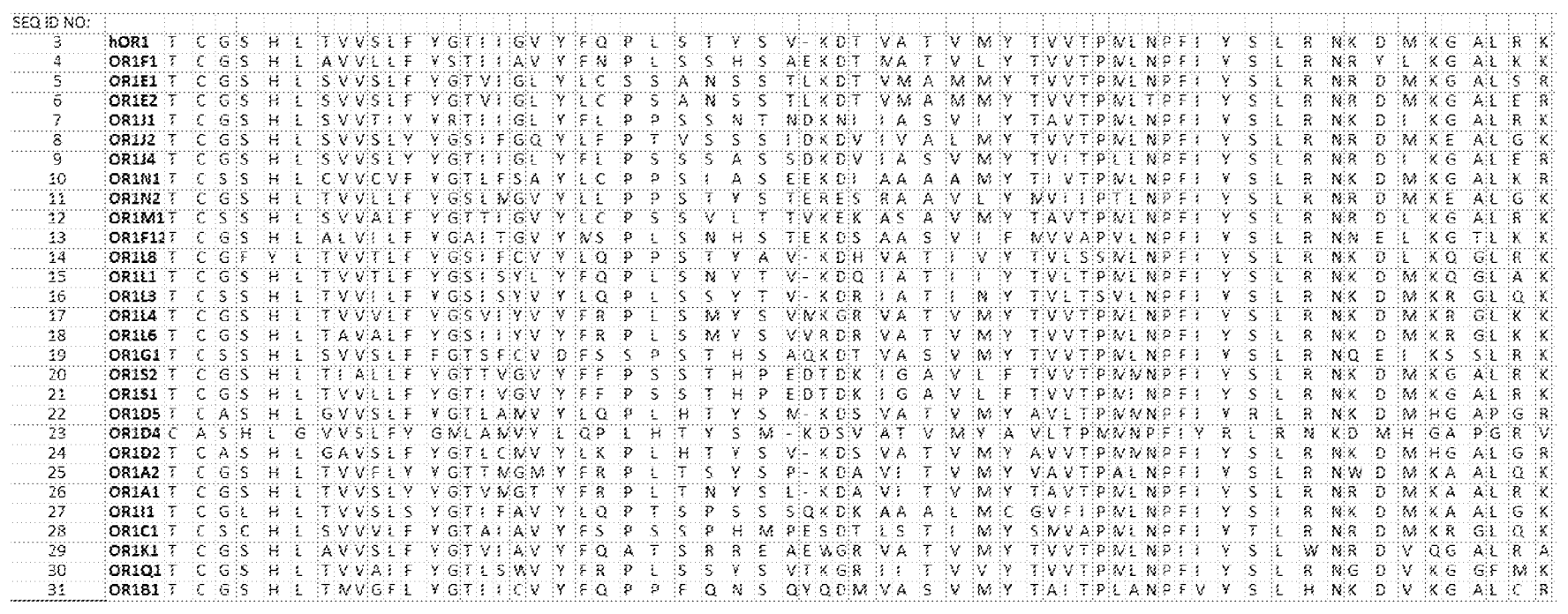
Figure 15:
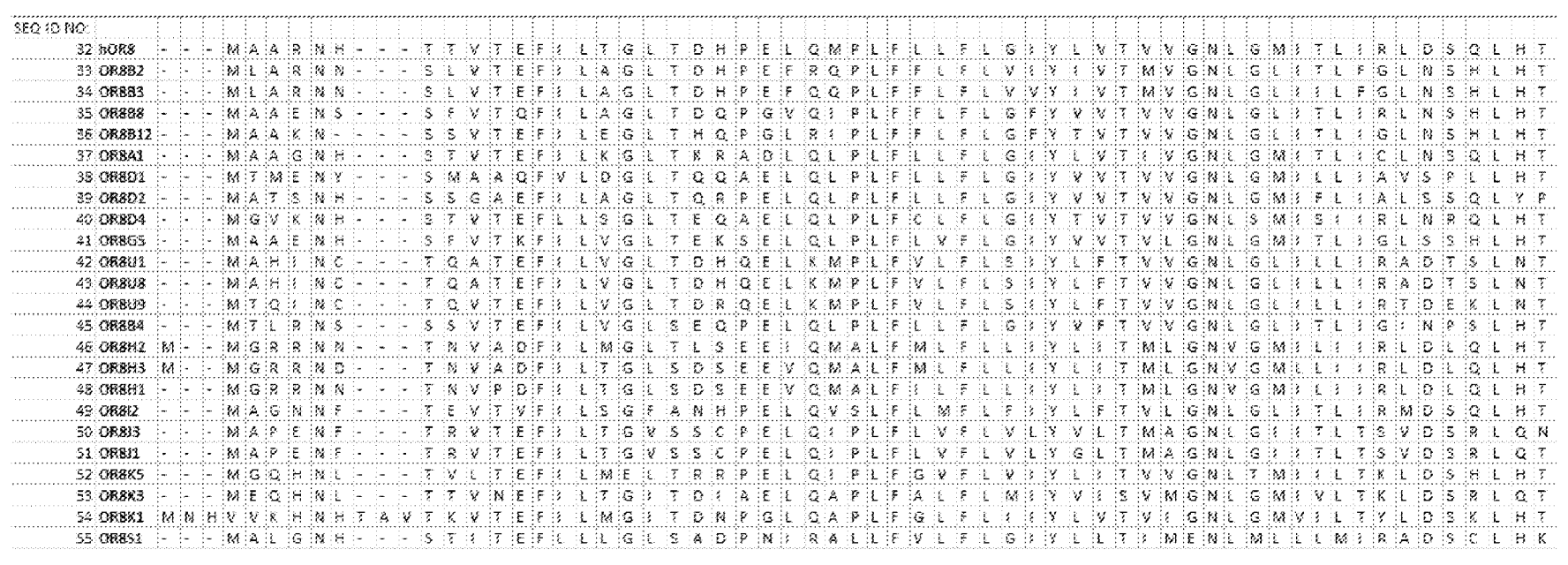
Figure 15:
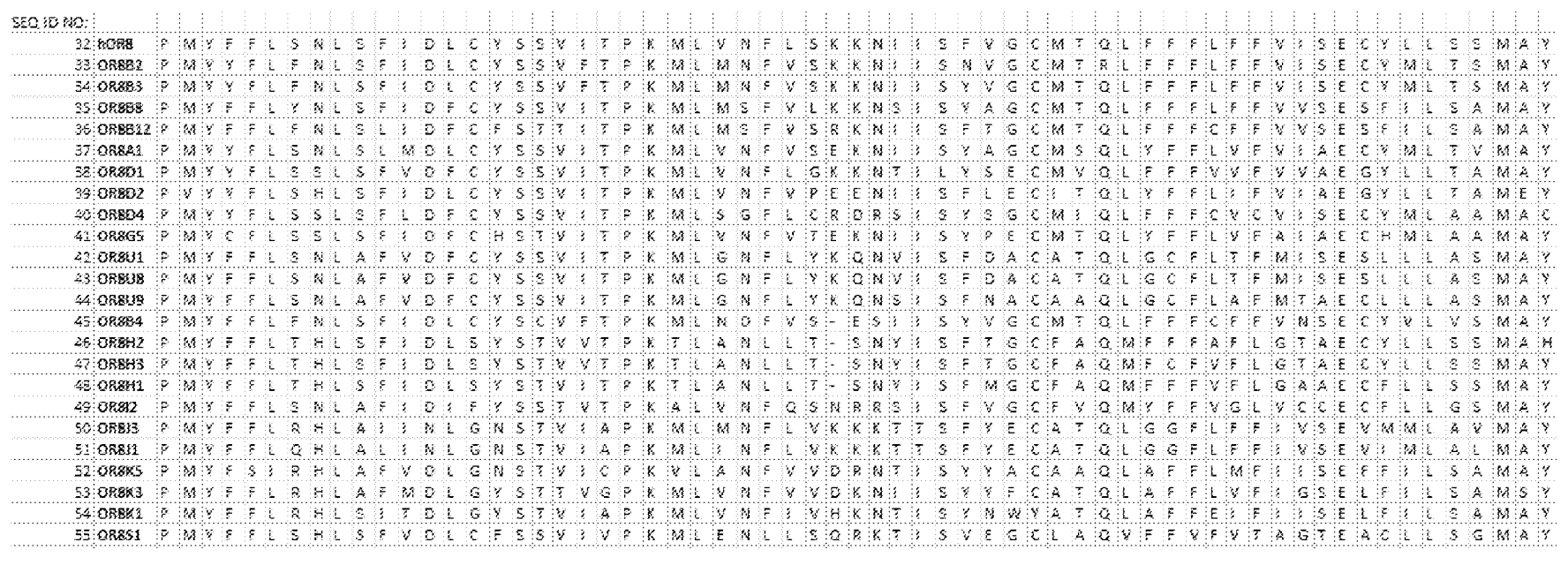
Figure 15:
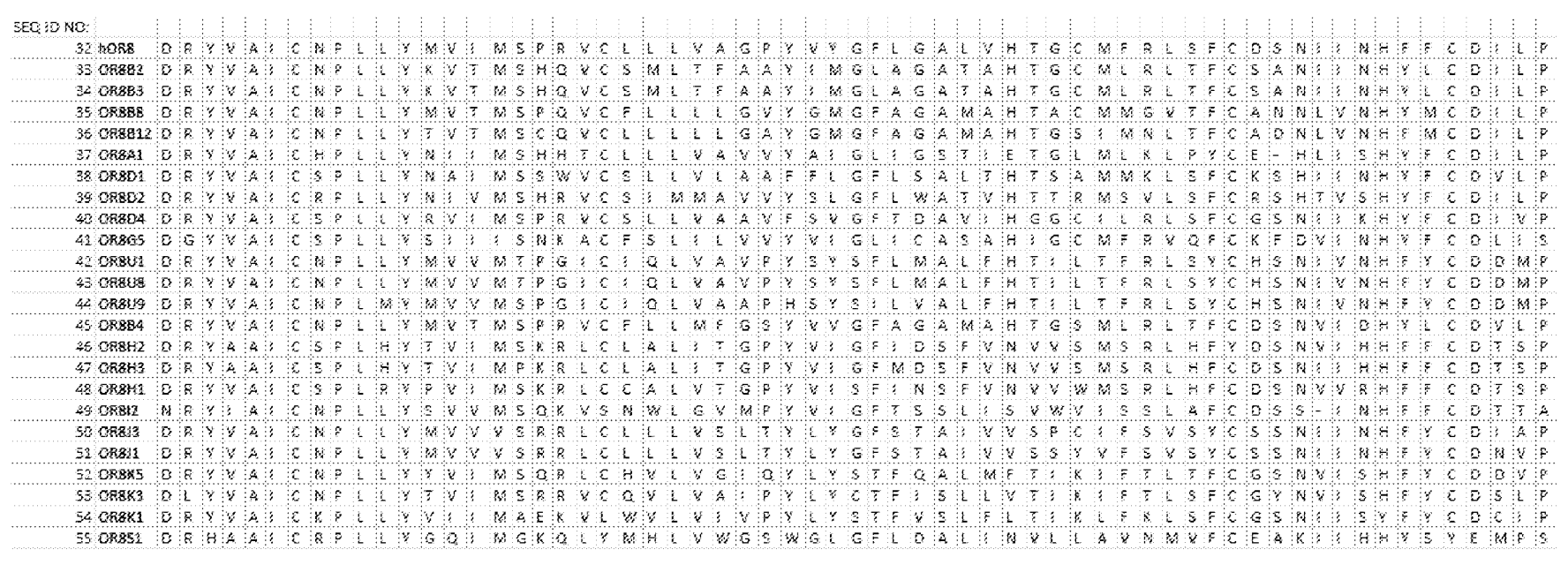
Figure 15:
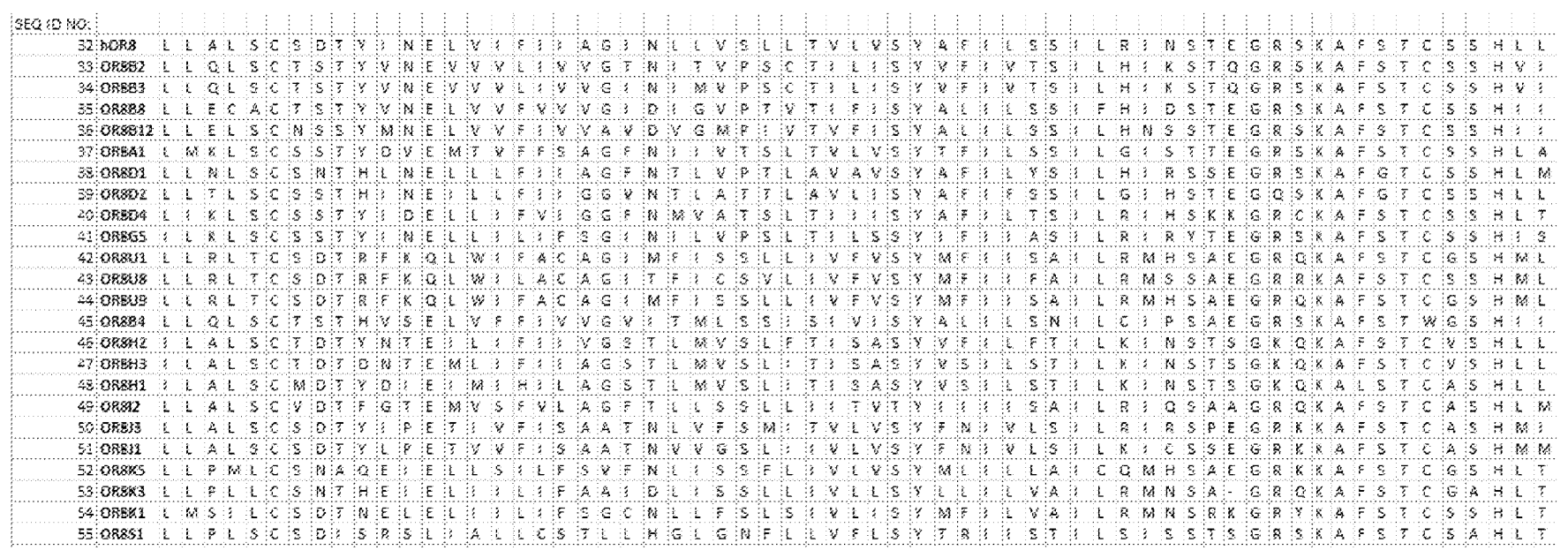
Figure 15:
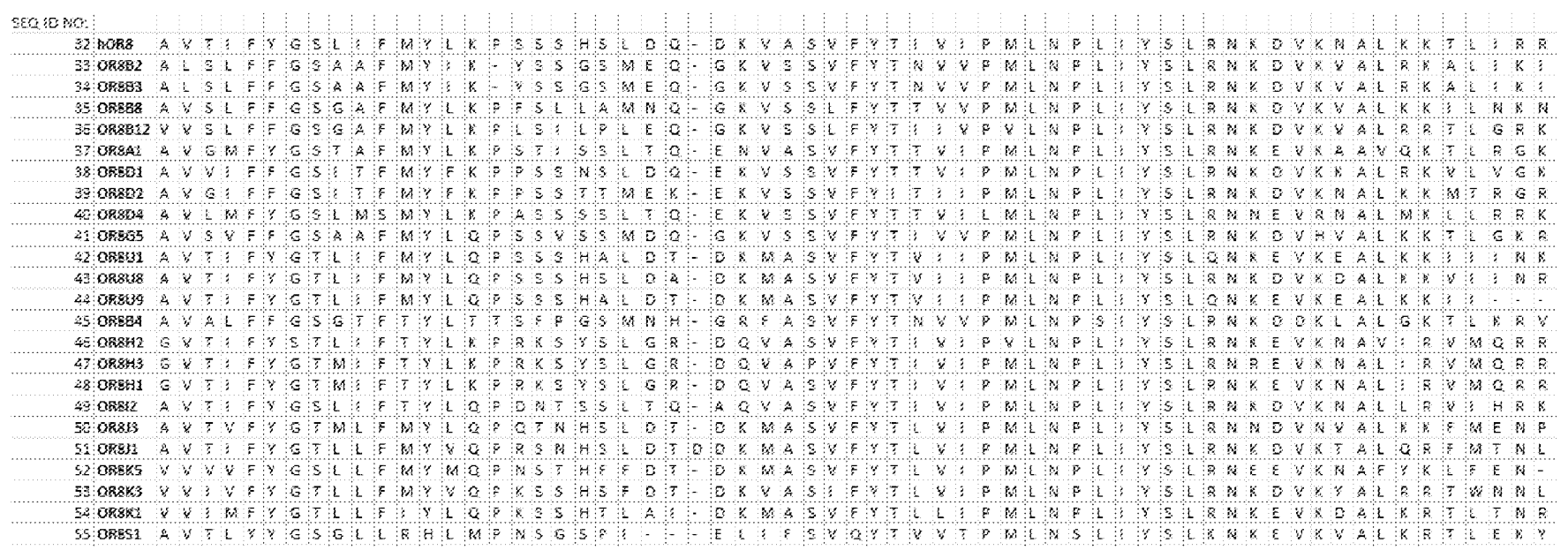
Figure 16:
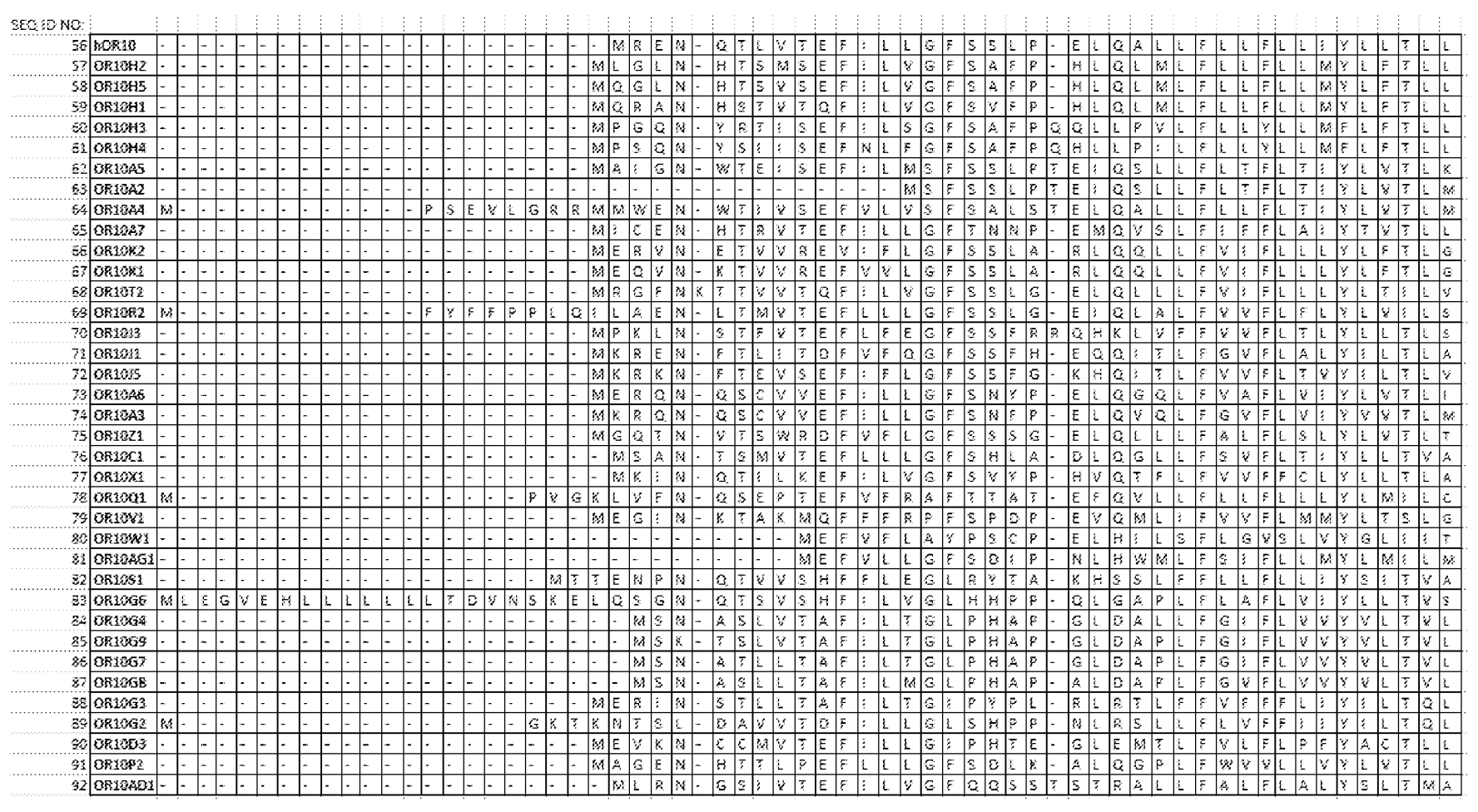
Figure 16:
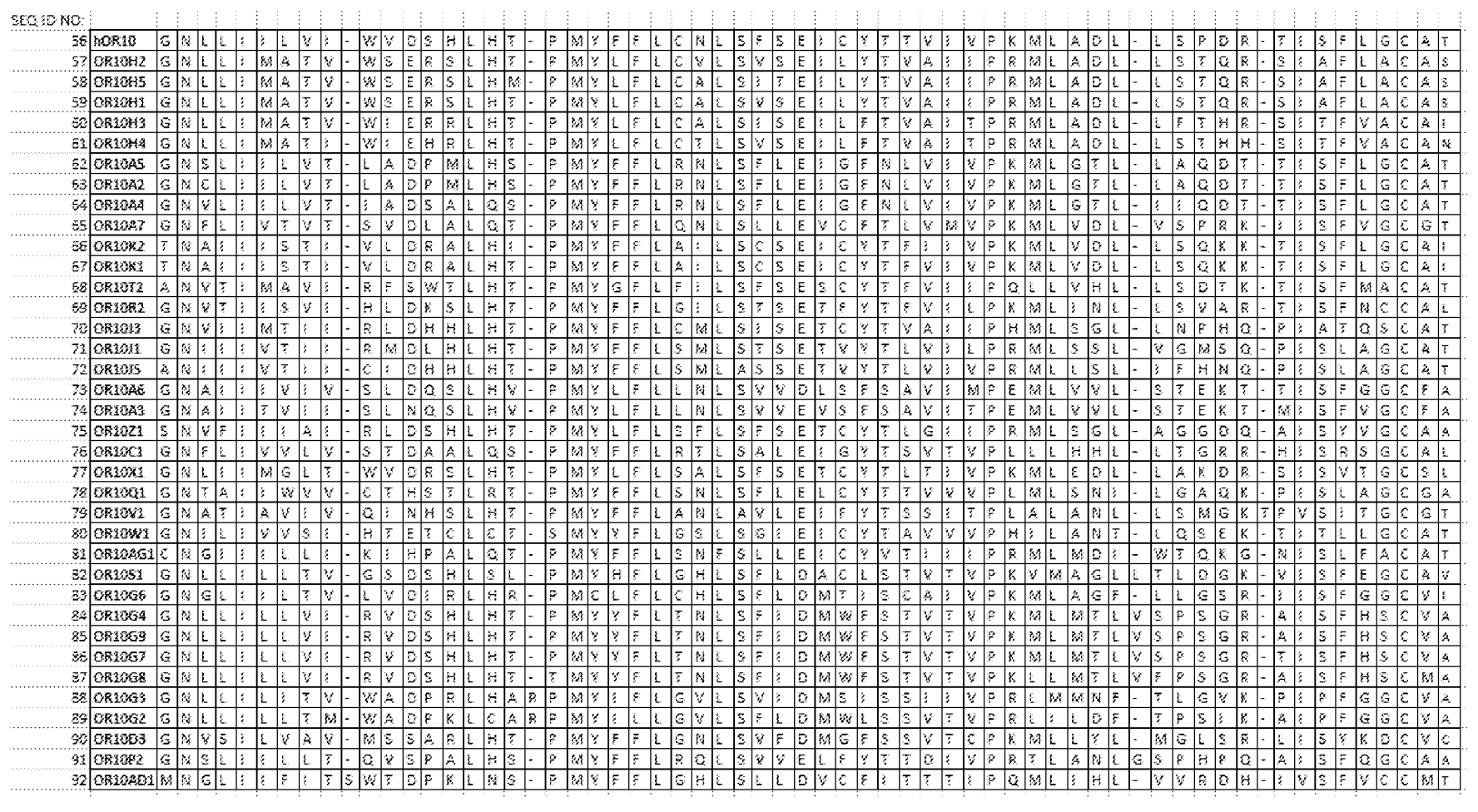
Figure 16:
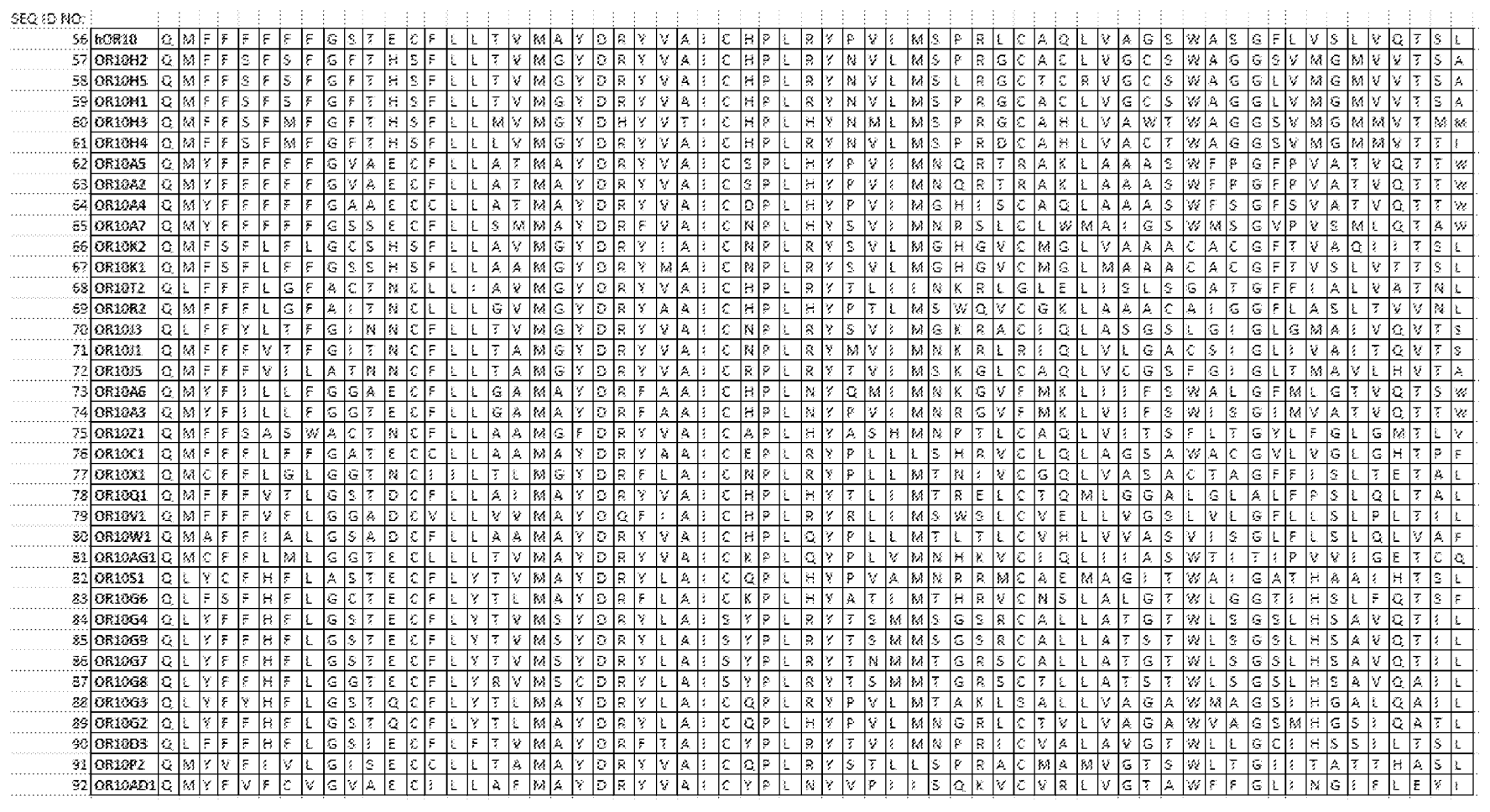
Figure 16:
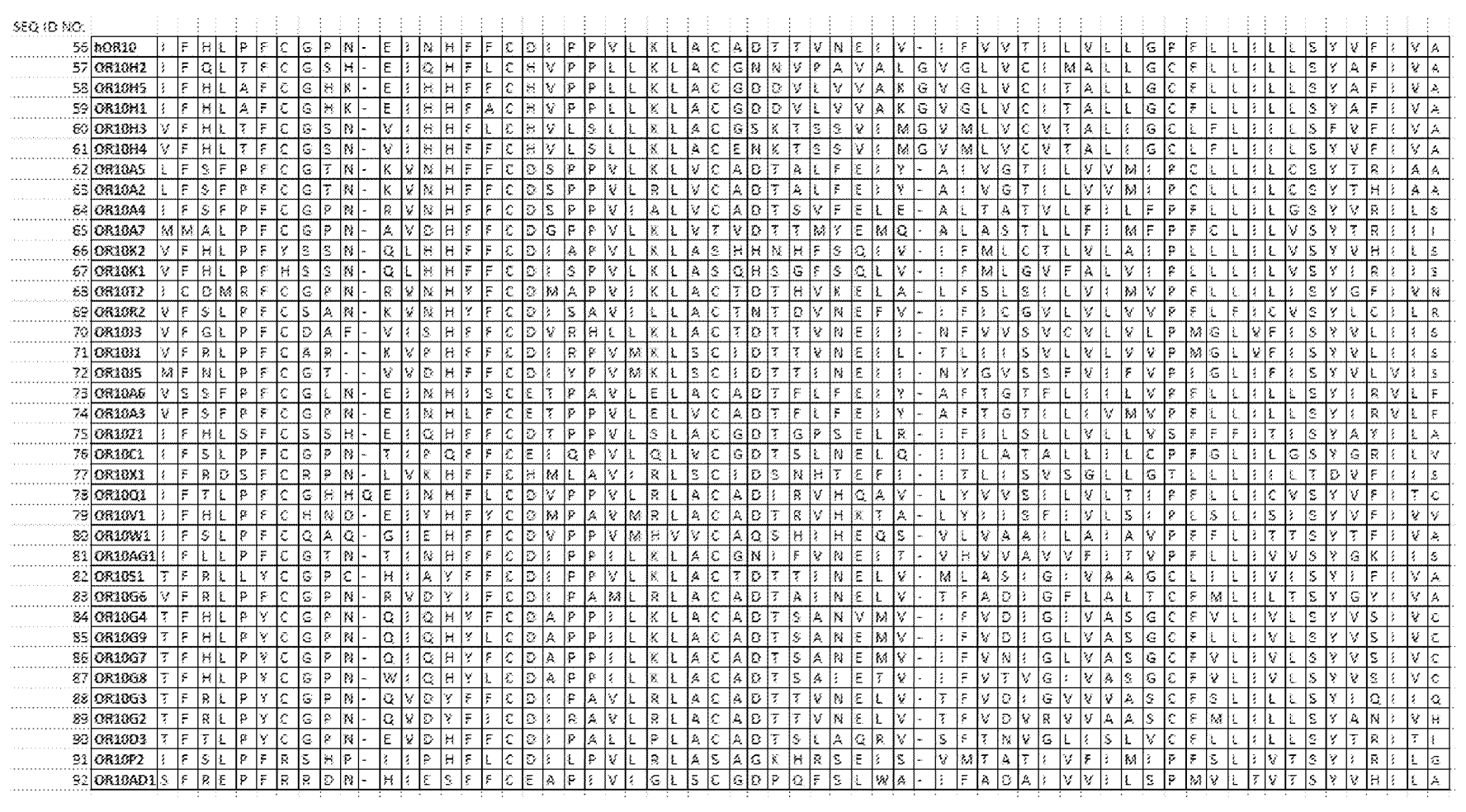
Figure 16:
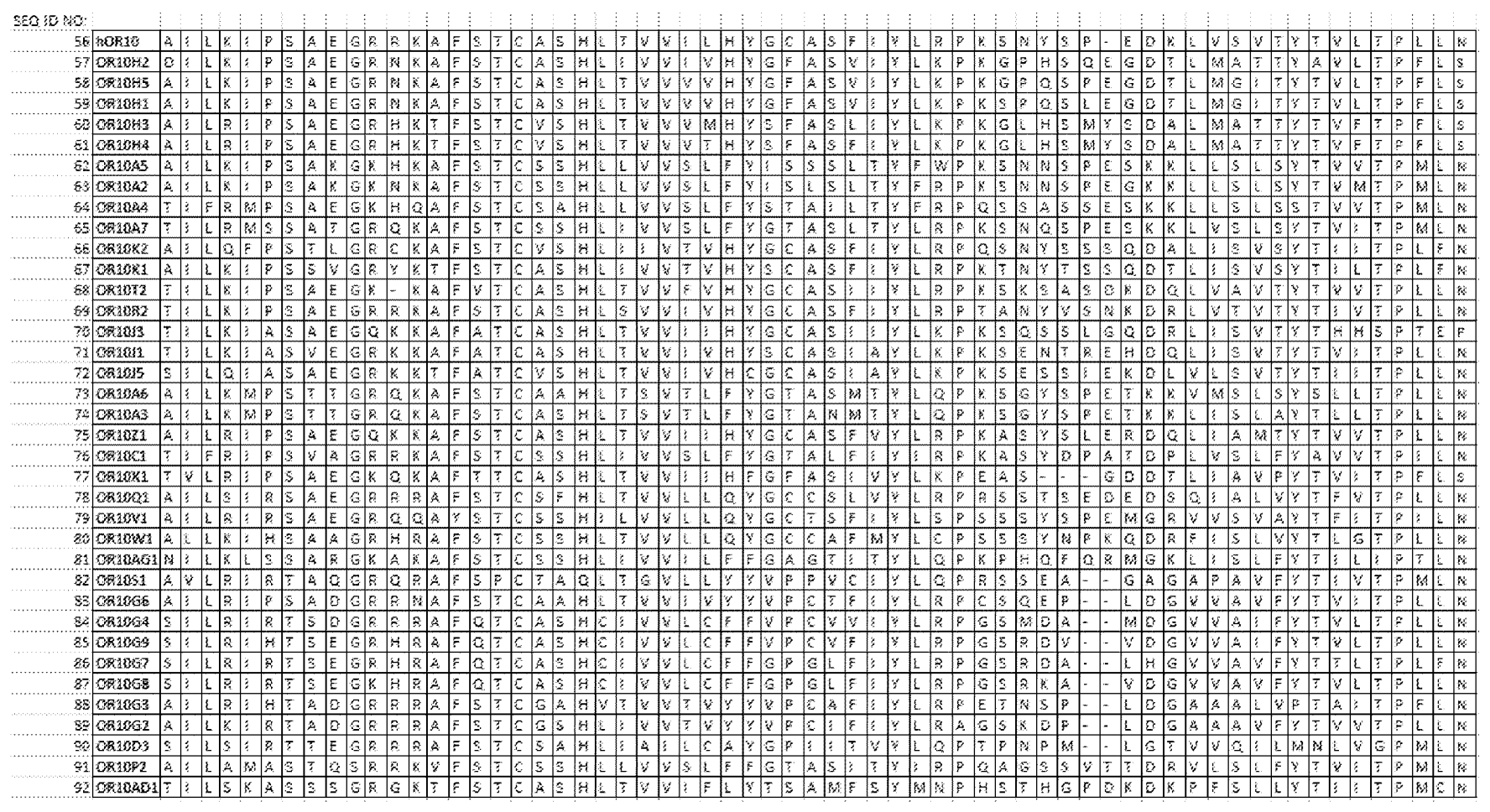
Figure 16:
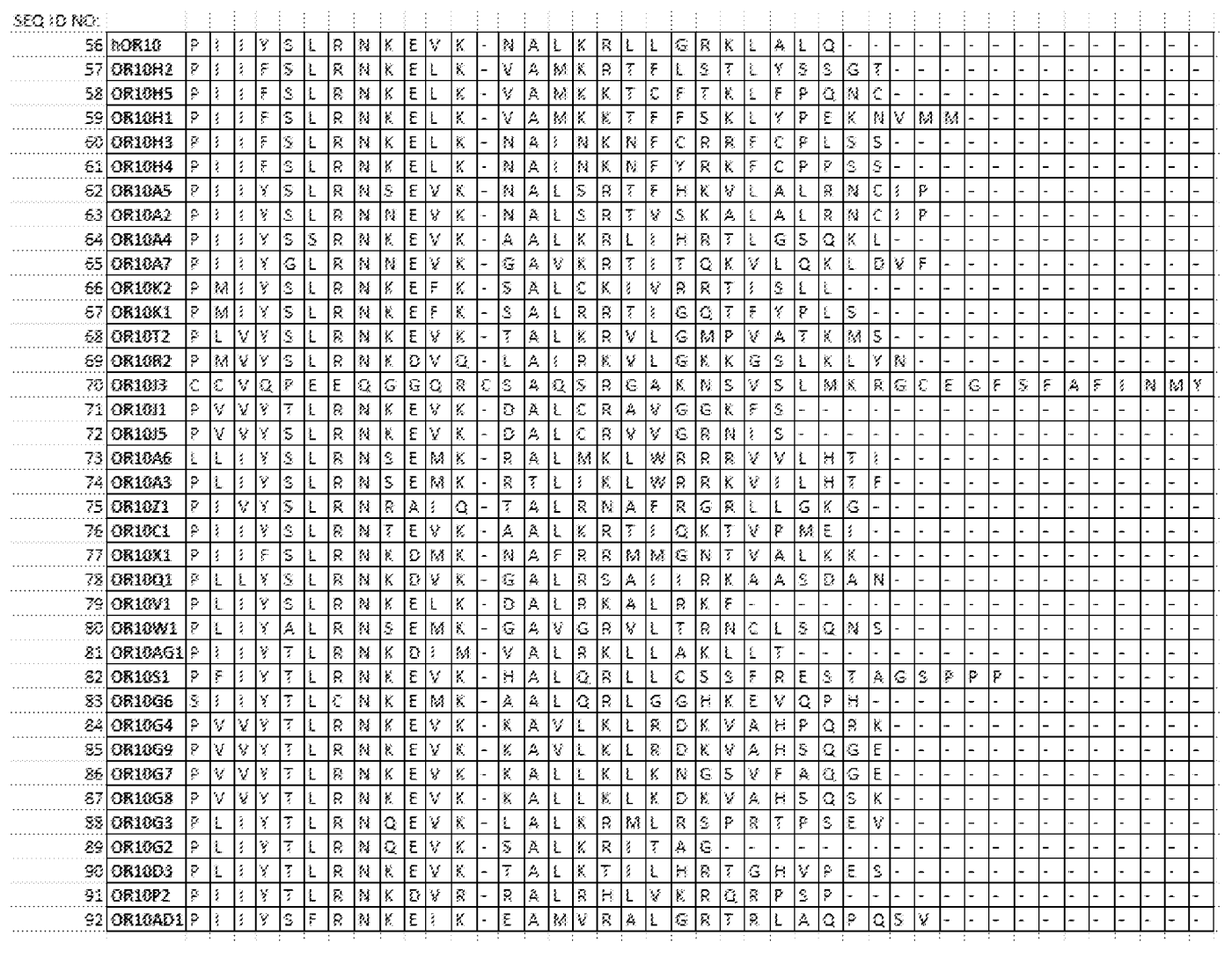
Figure 17:
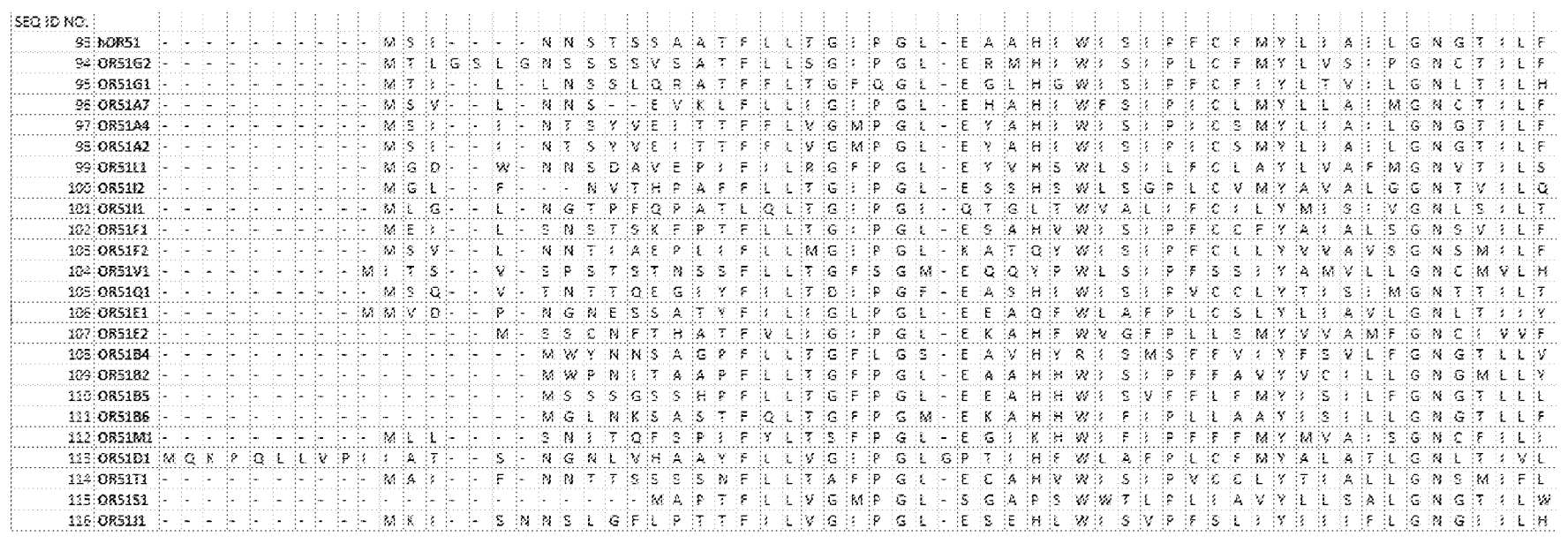
Figure 17:
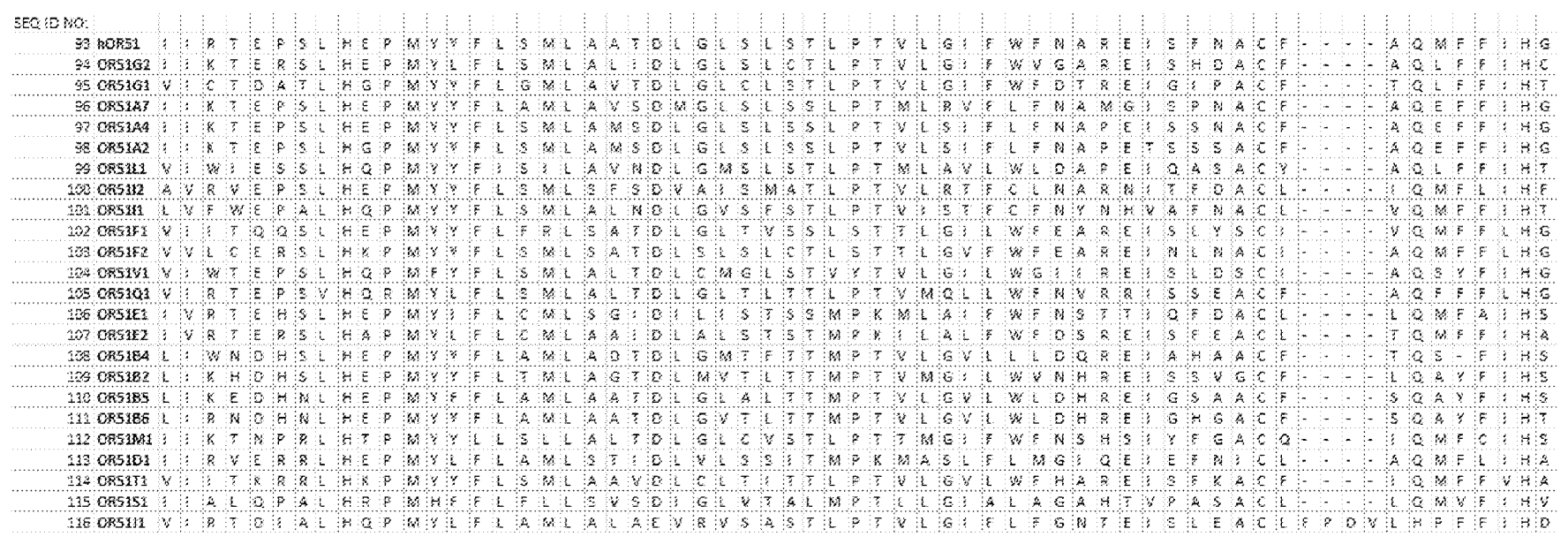
Figure 17:
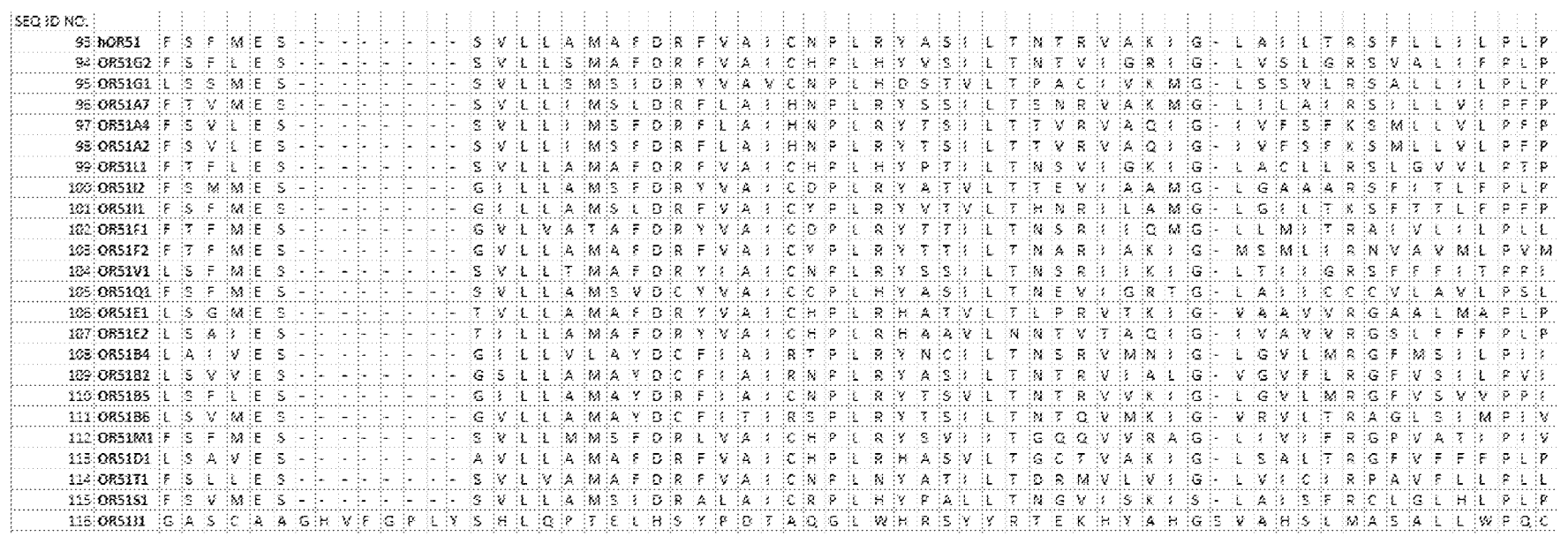
Figure 17:
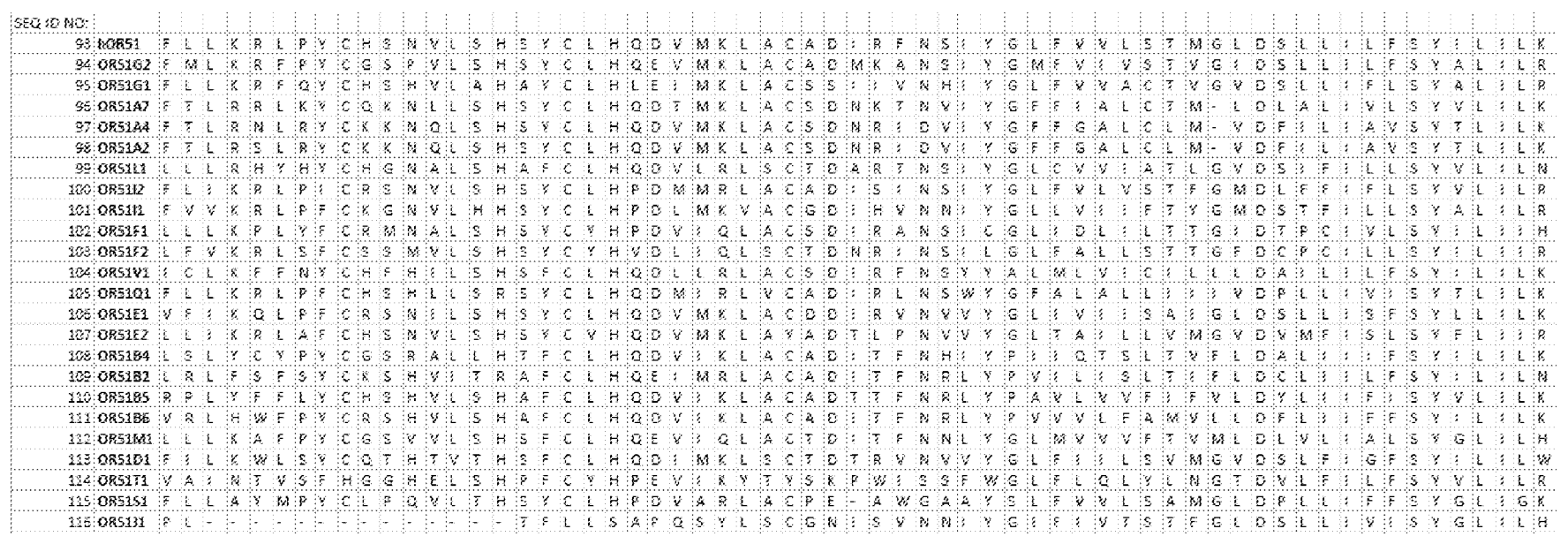
Figure 17:
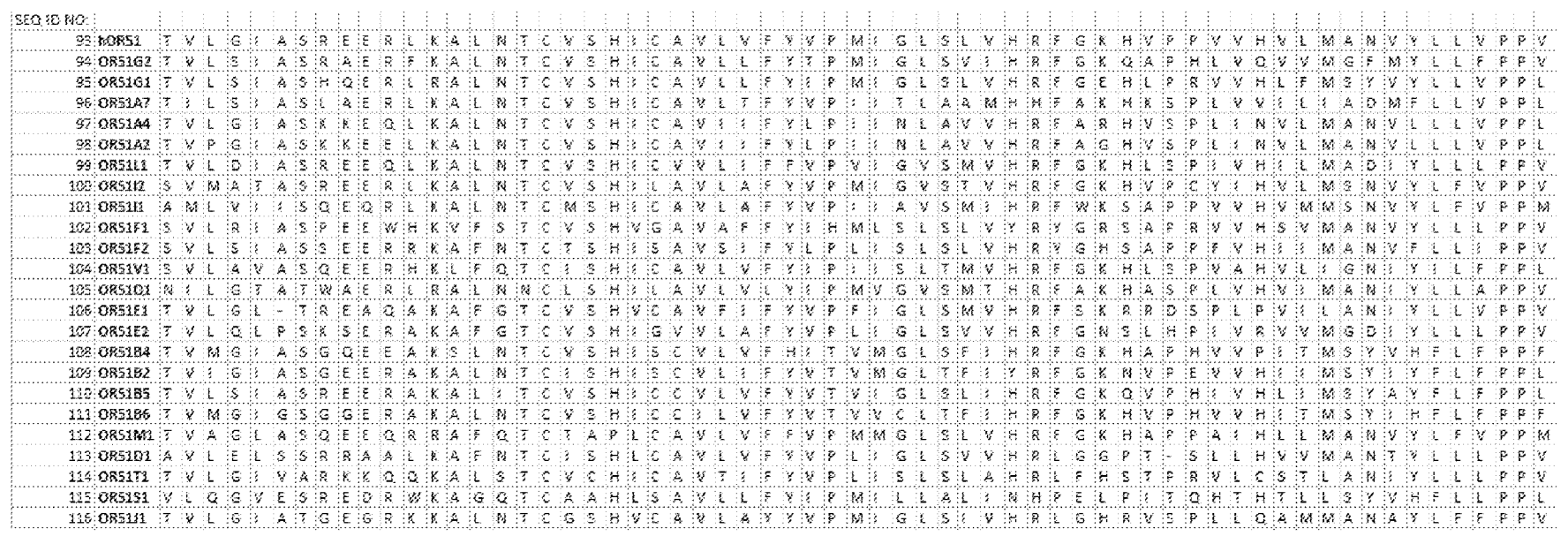
Figure 17:
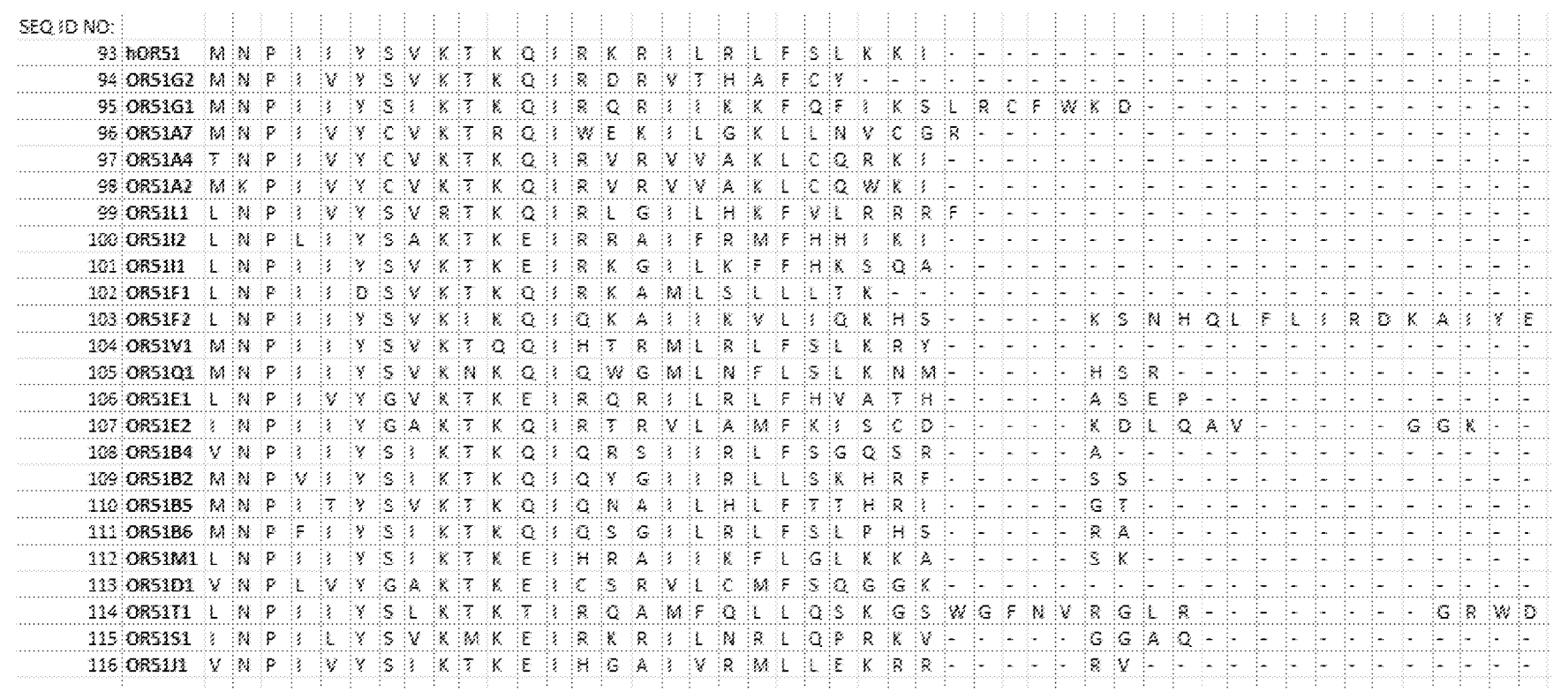
Figure 18:
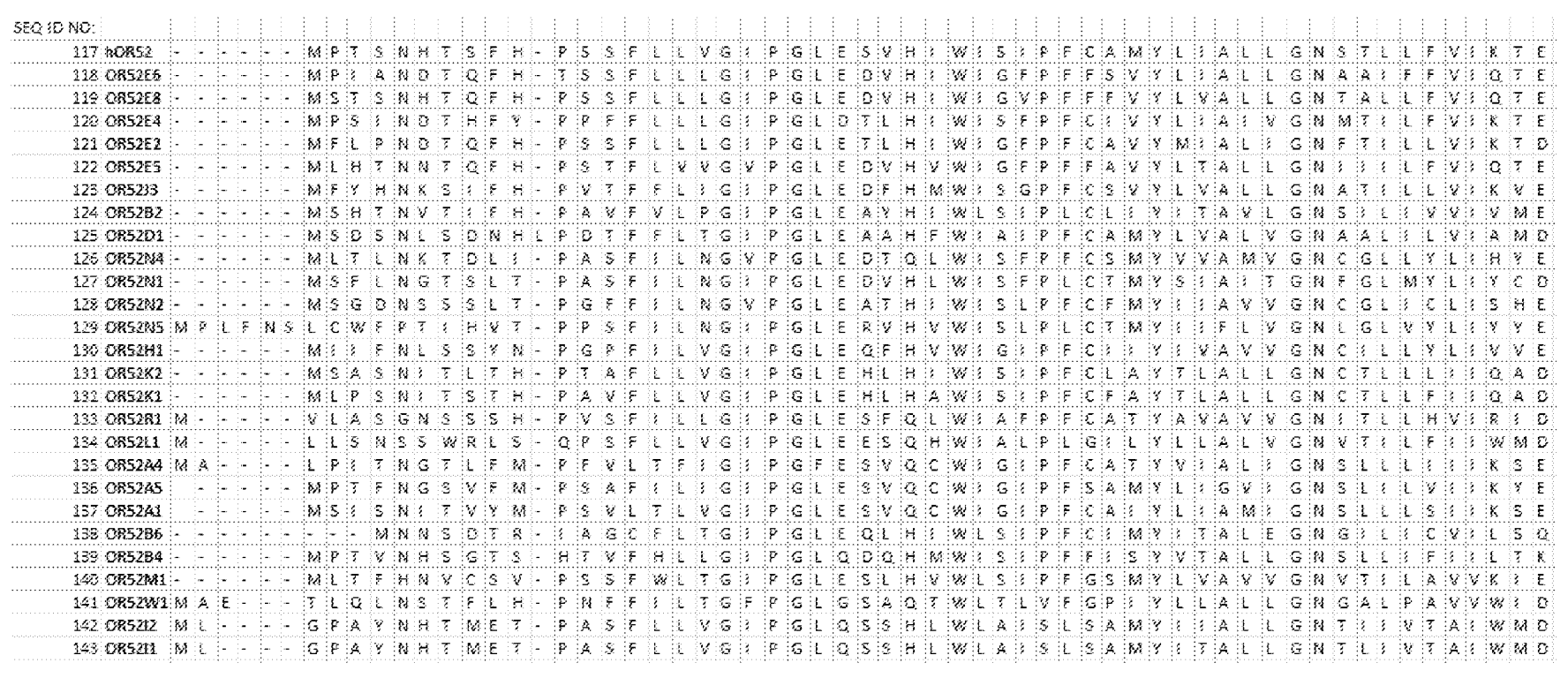
Figure 18:
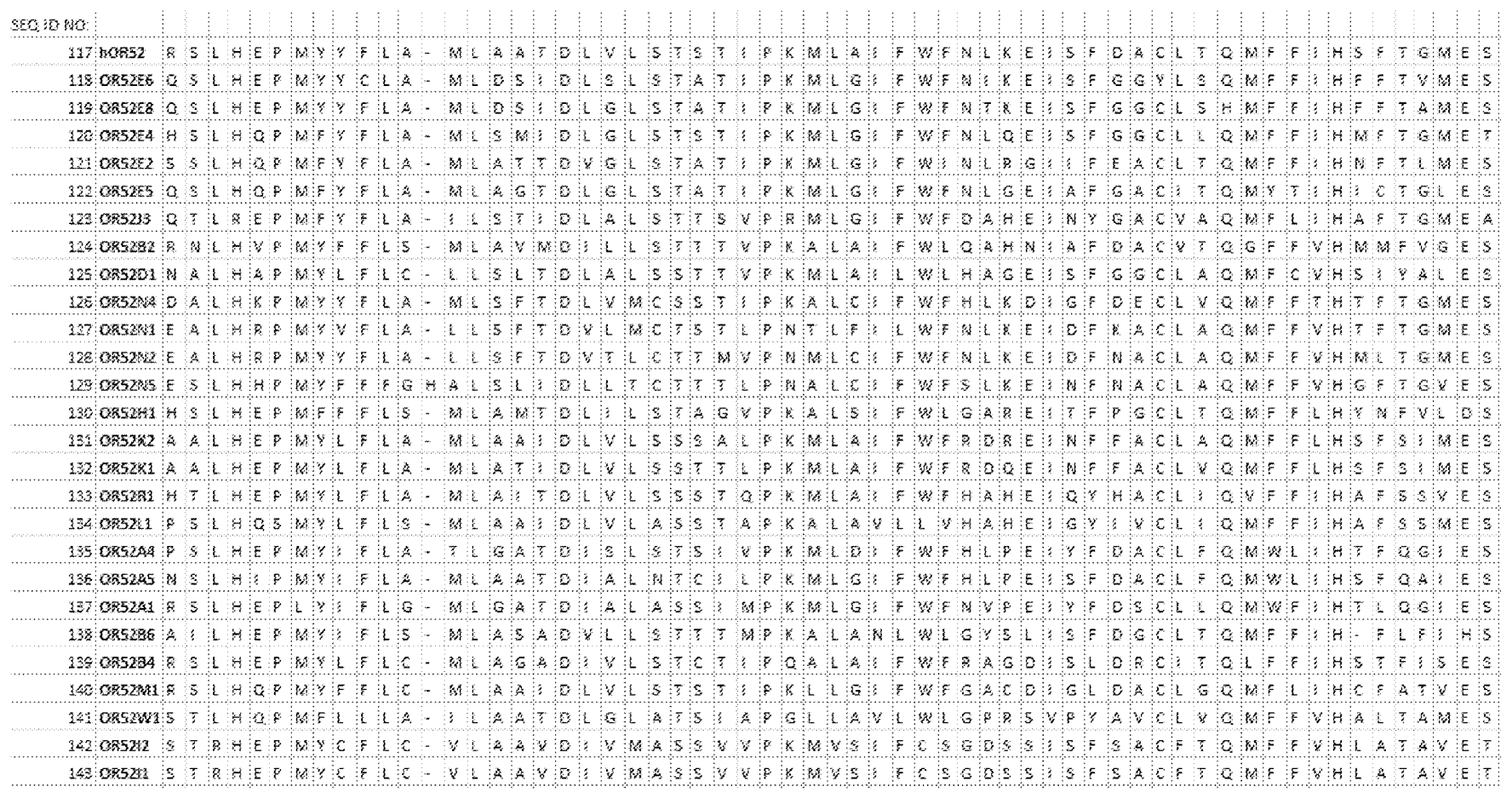
Figure 18:
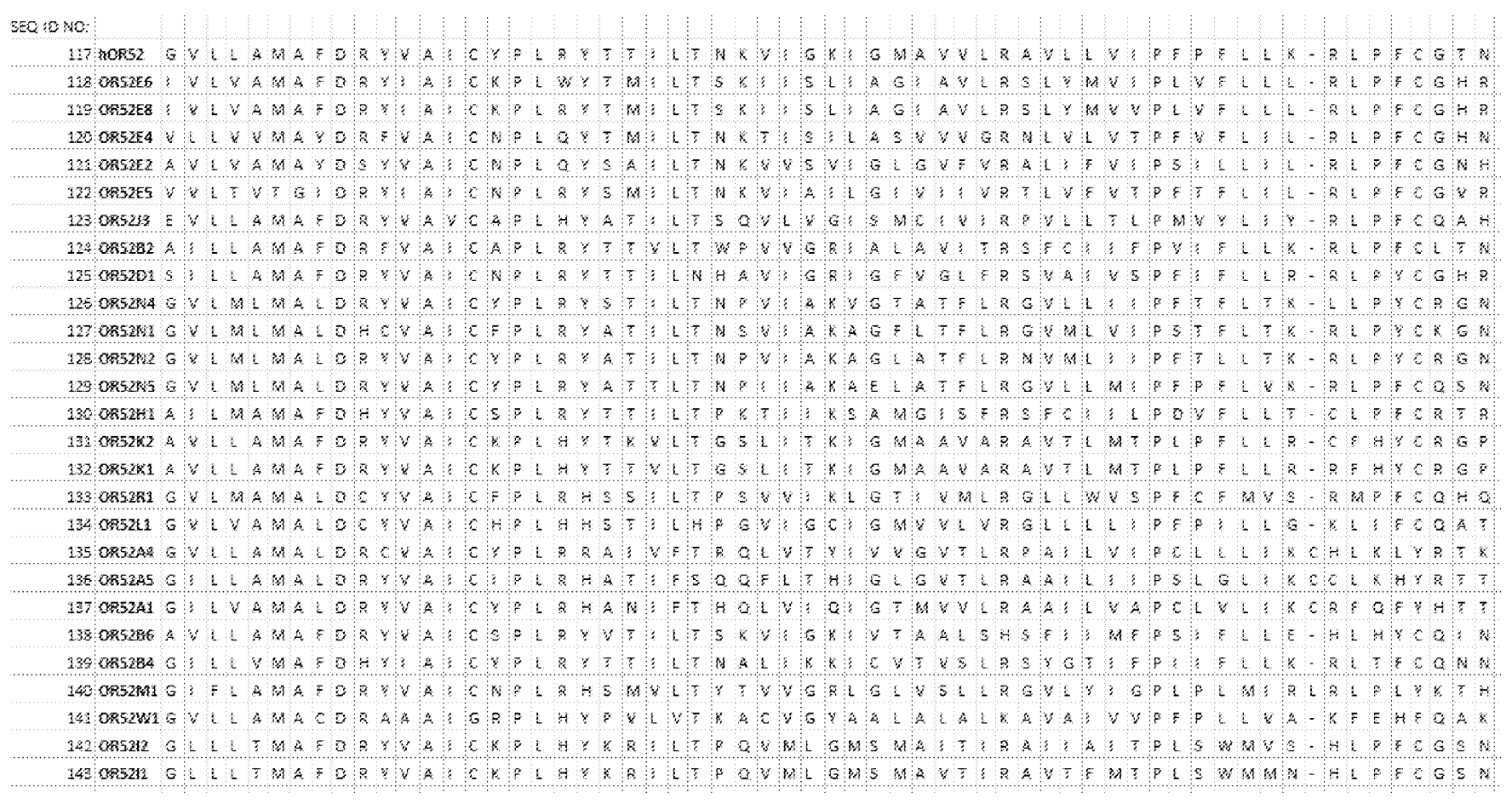
Figure 18:
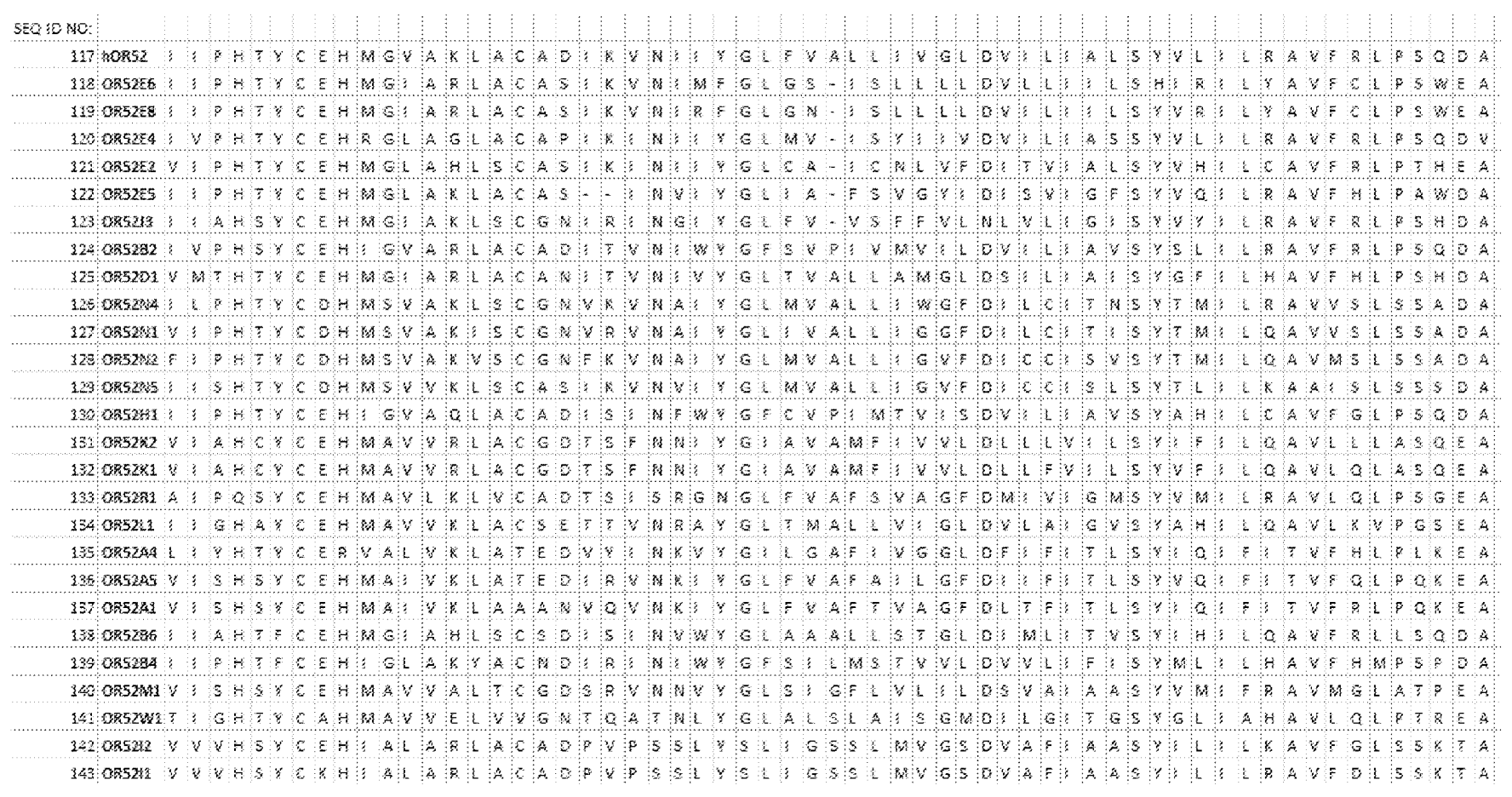
Figure 18:
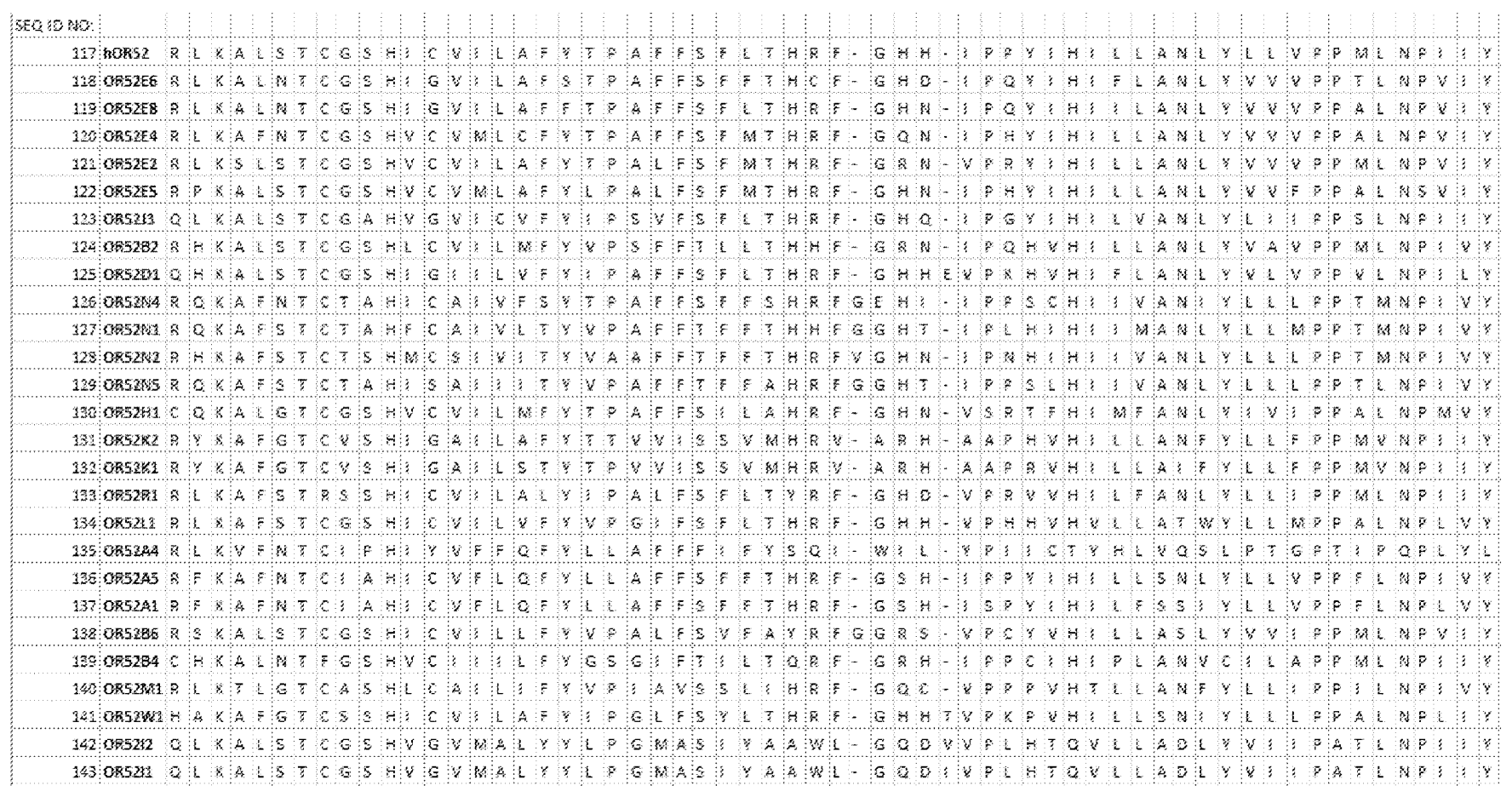
Figure 18:
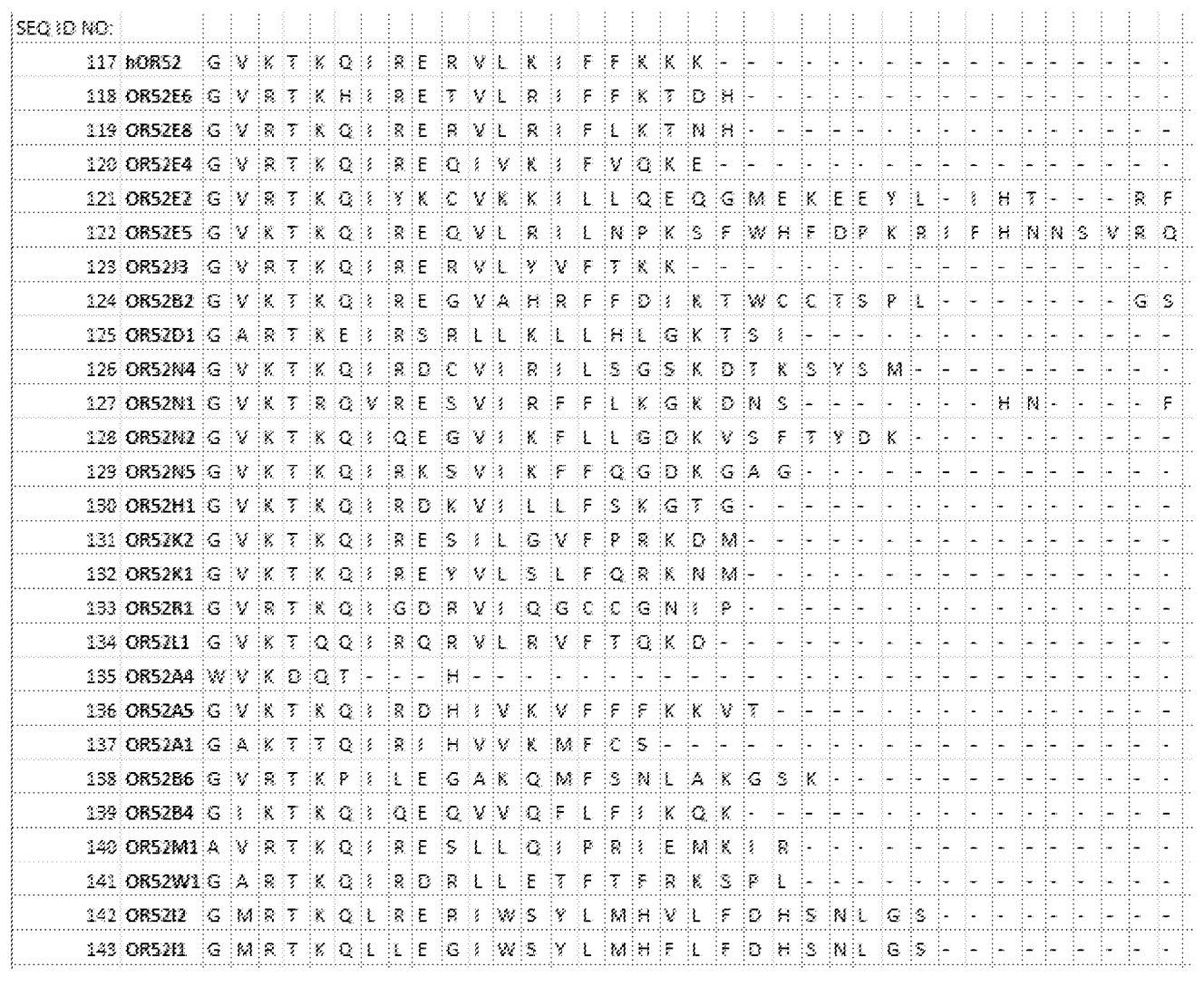
Figure 19:
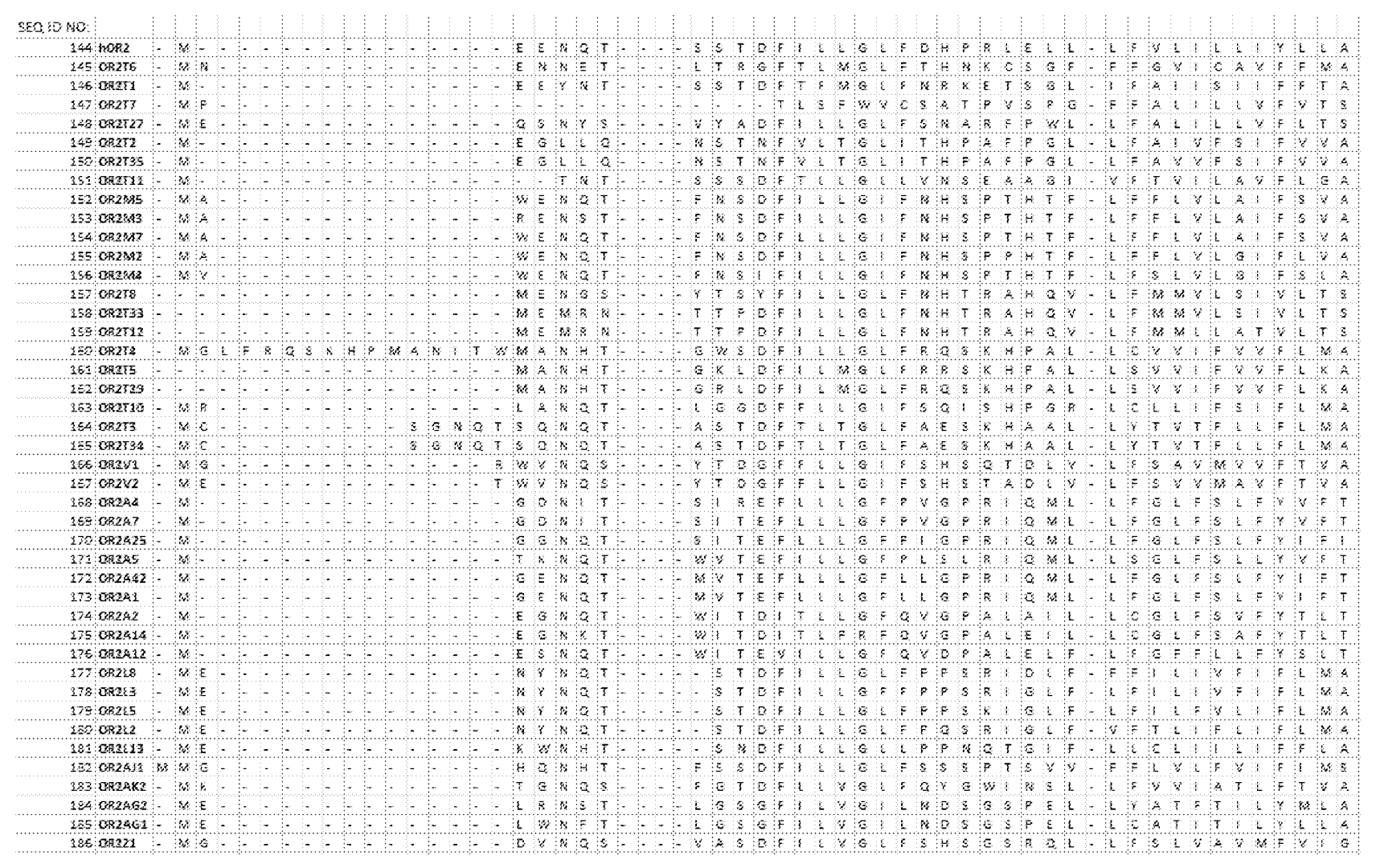
Figure 19:
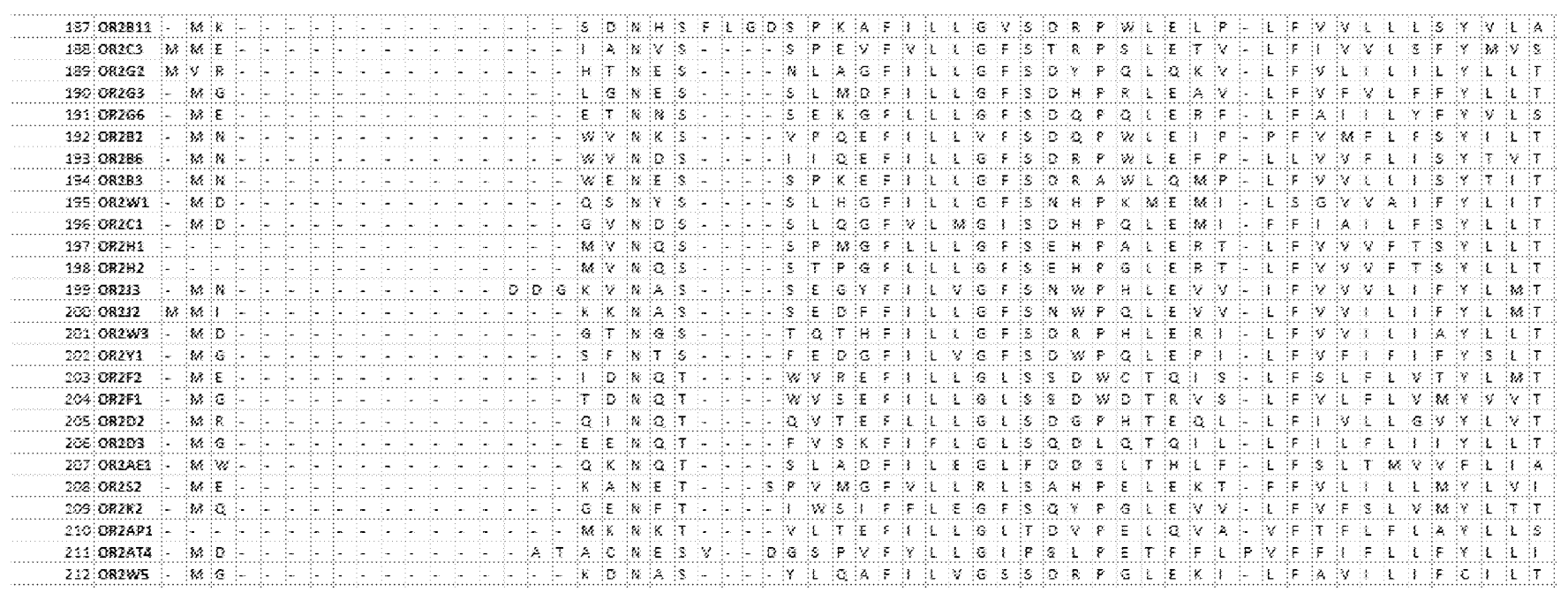
Figure 19:
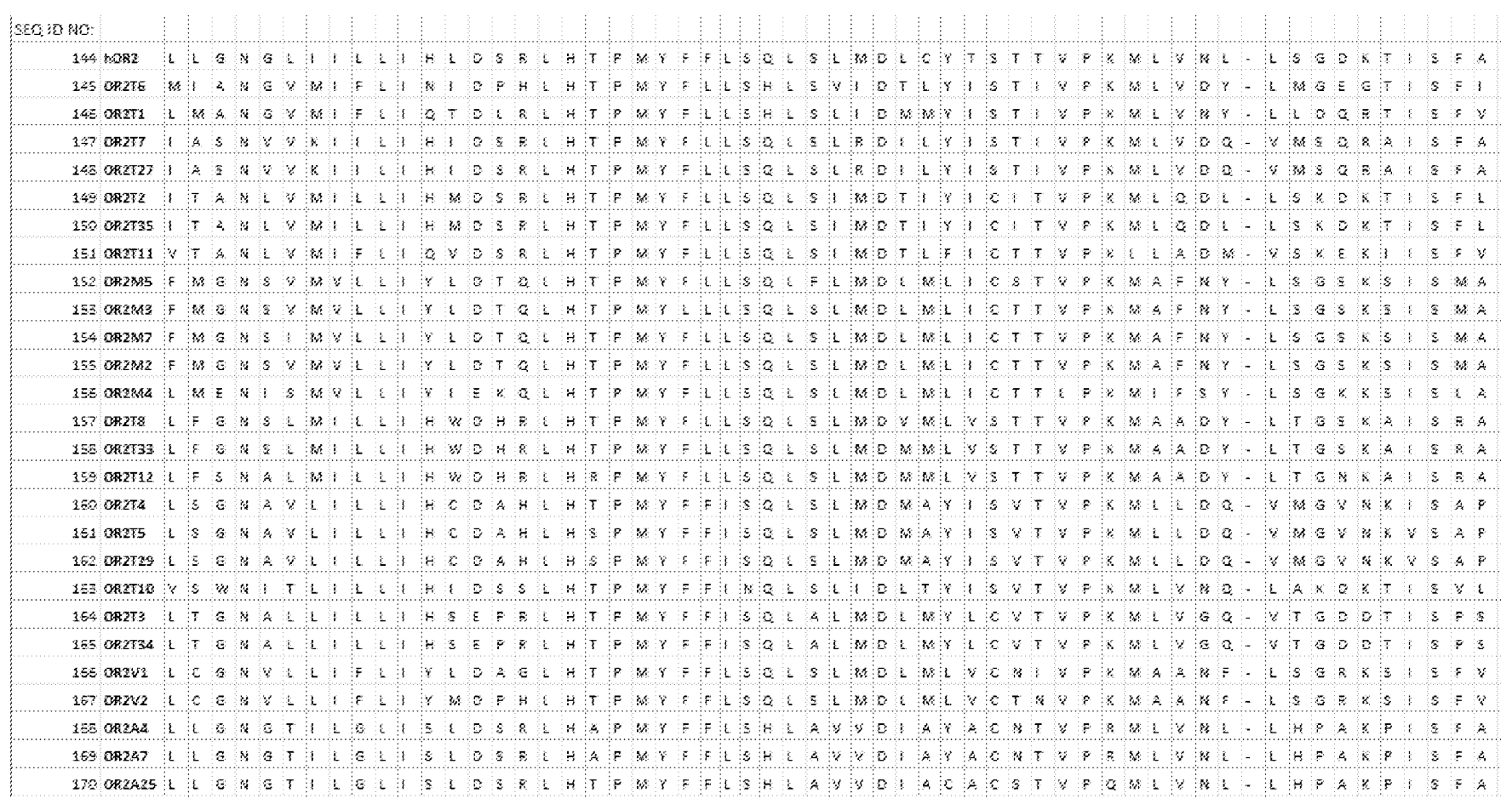
Figure 19:
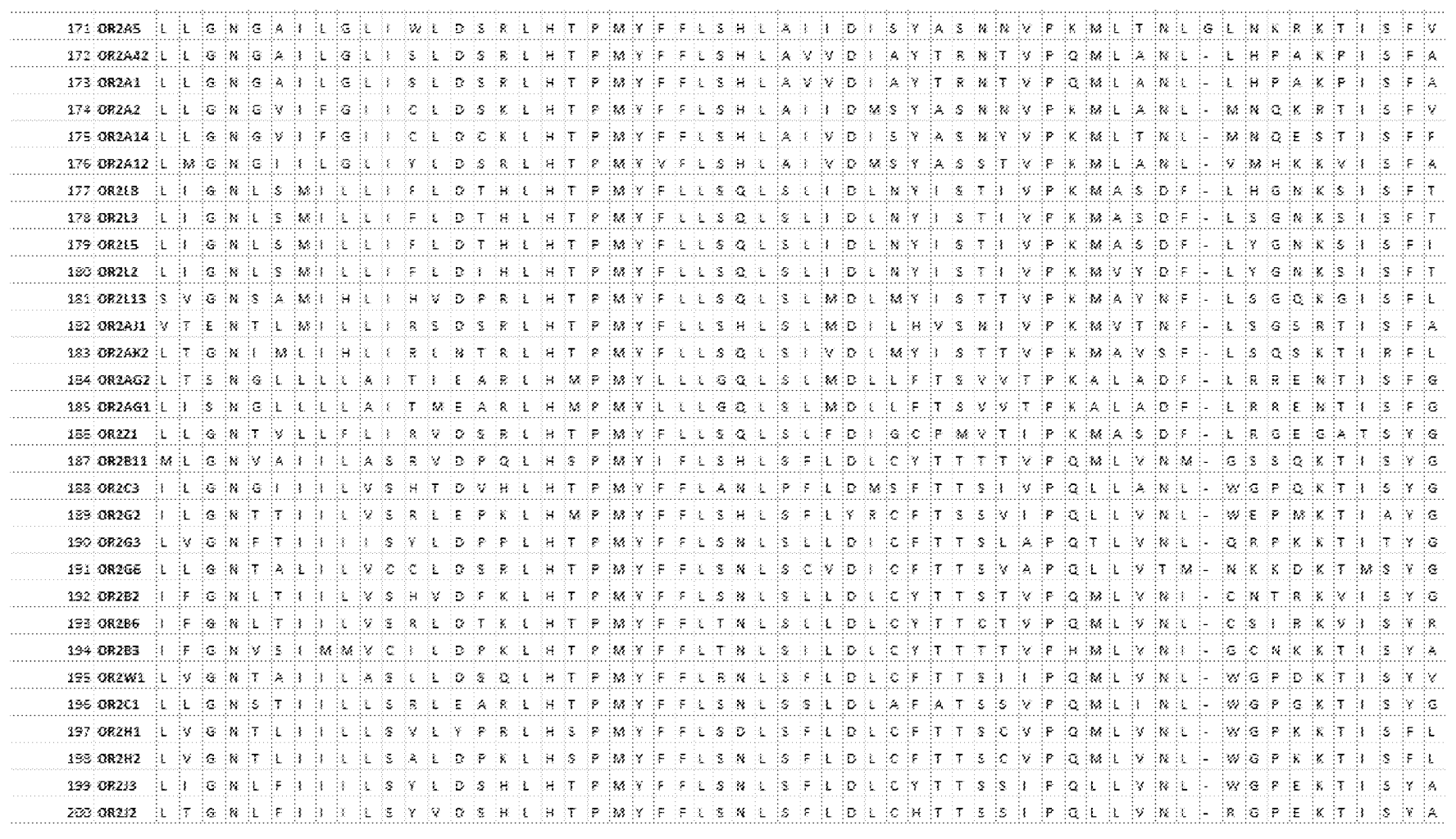
Figure 19:
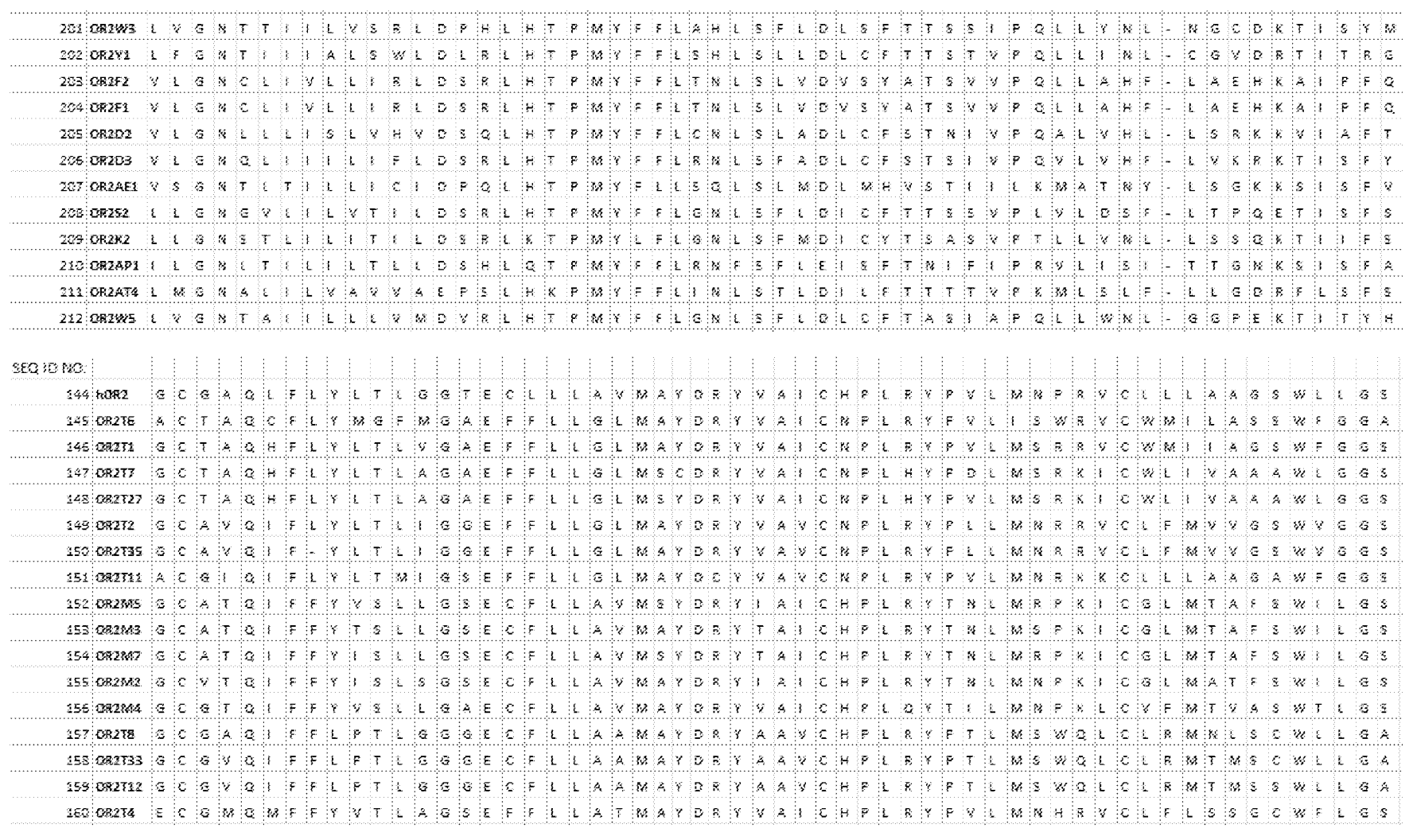
Figure 19:
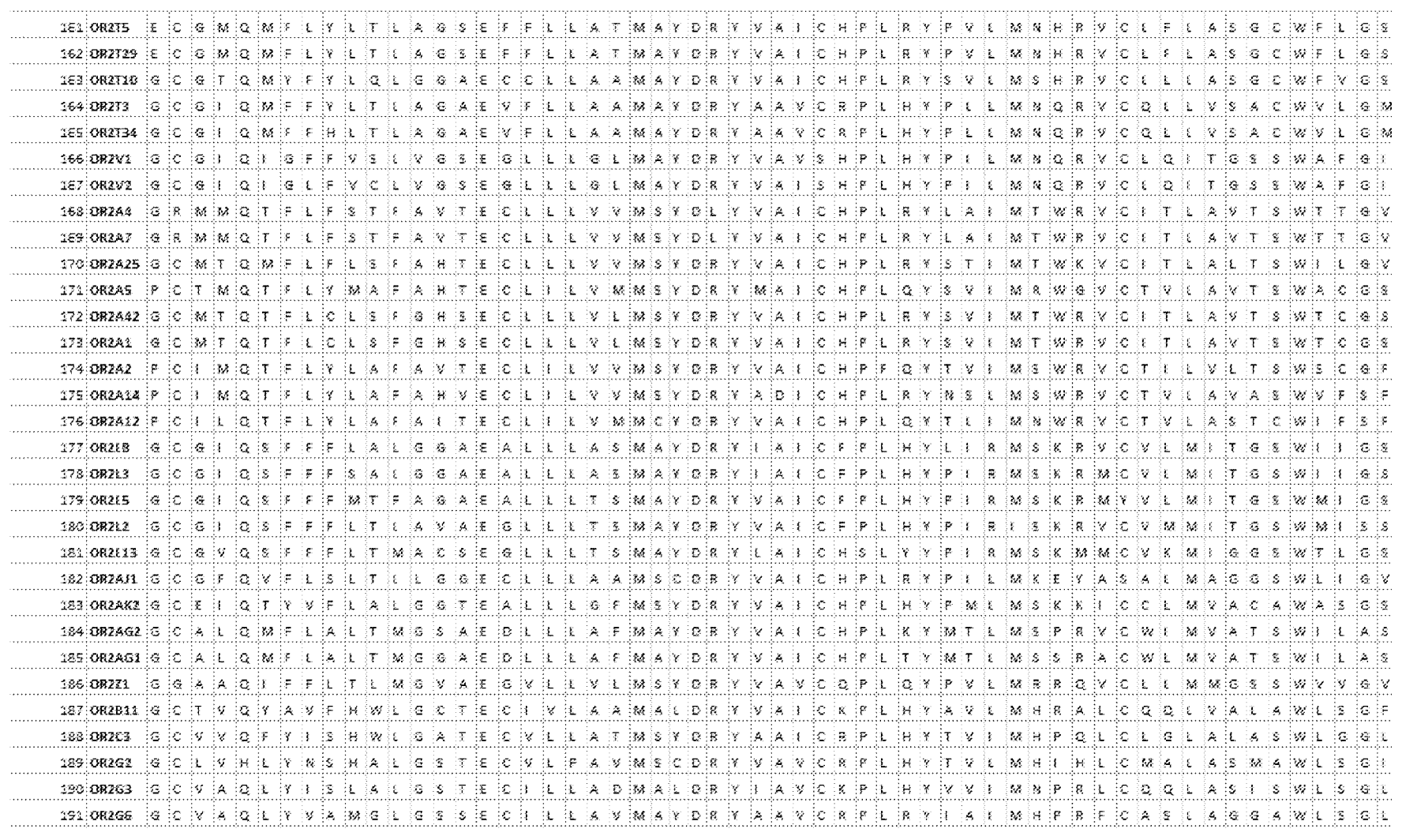
Figure 19:
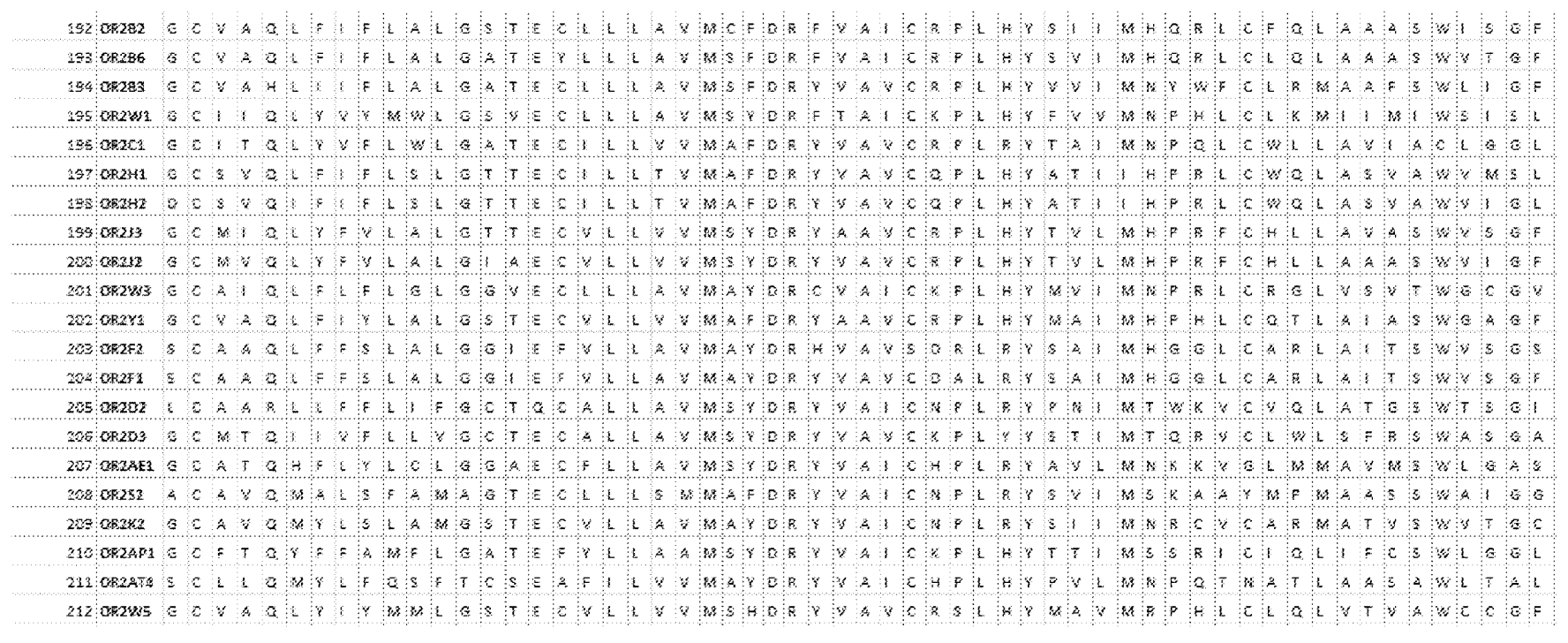
Figure 19:
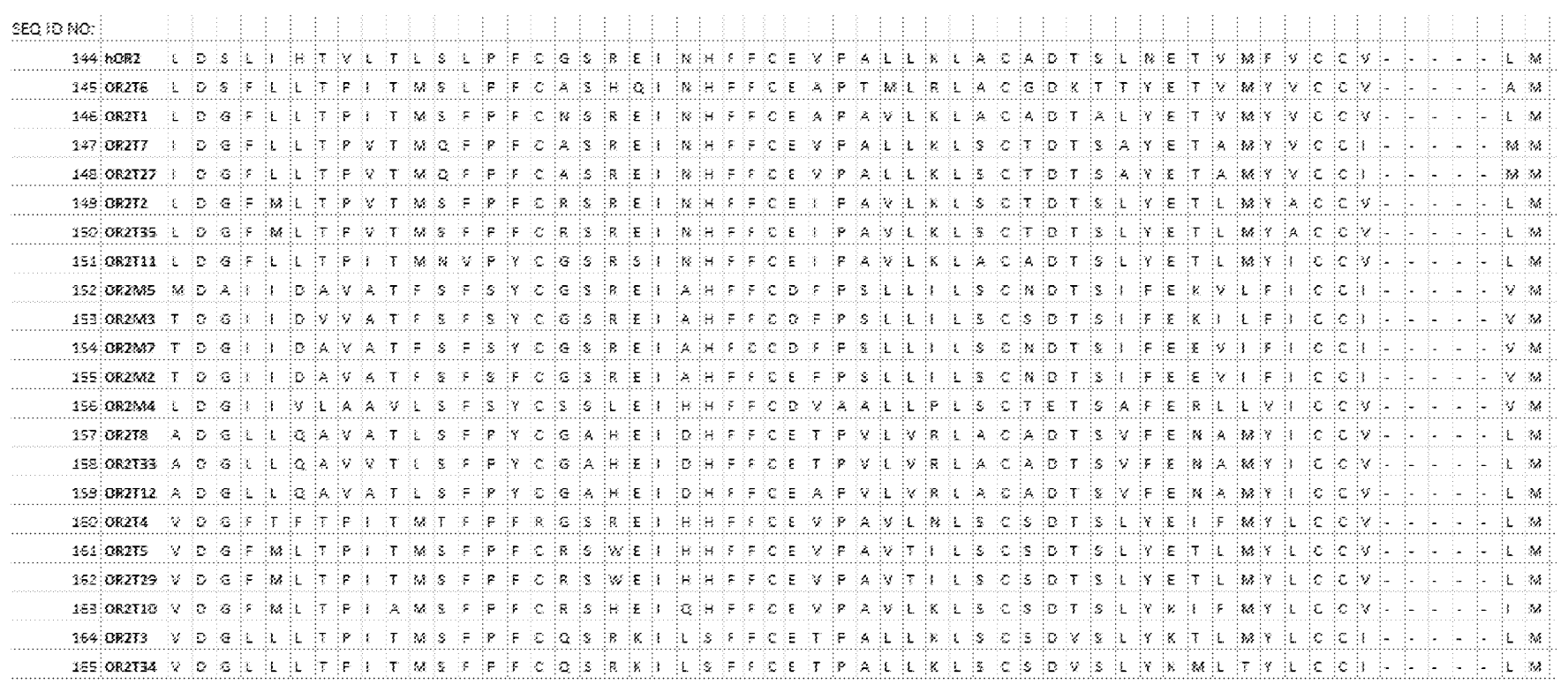
Figure 19:
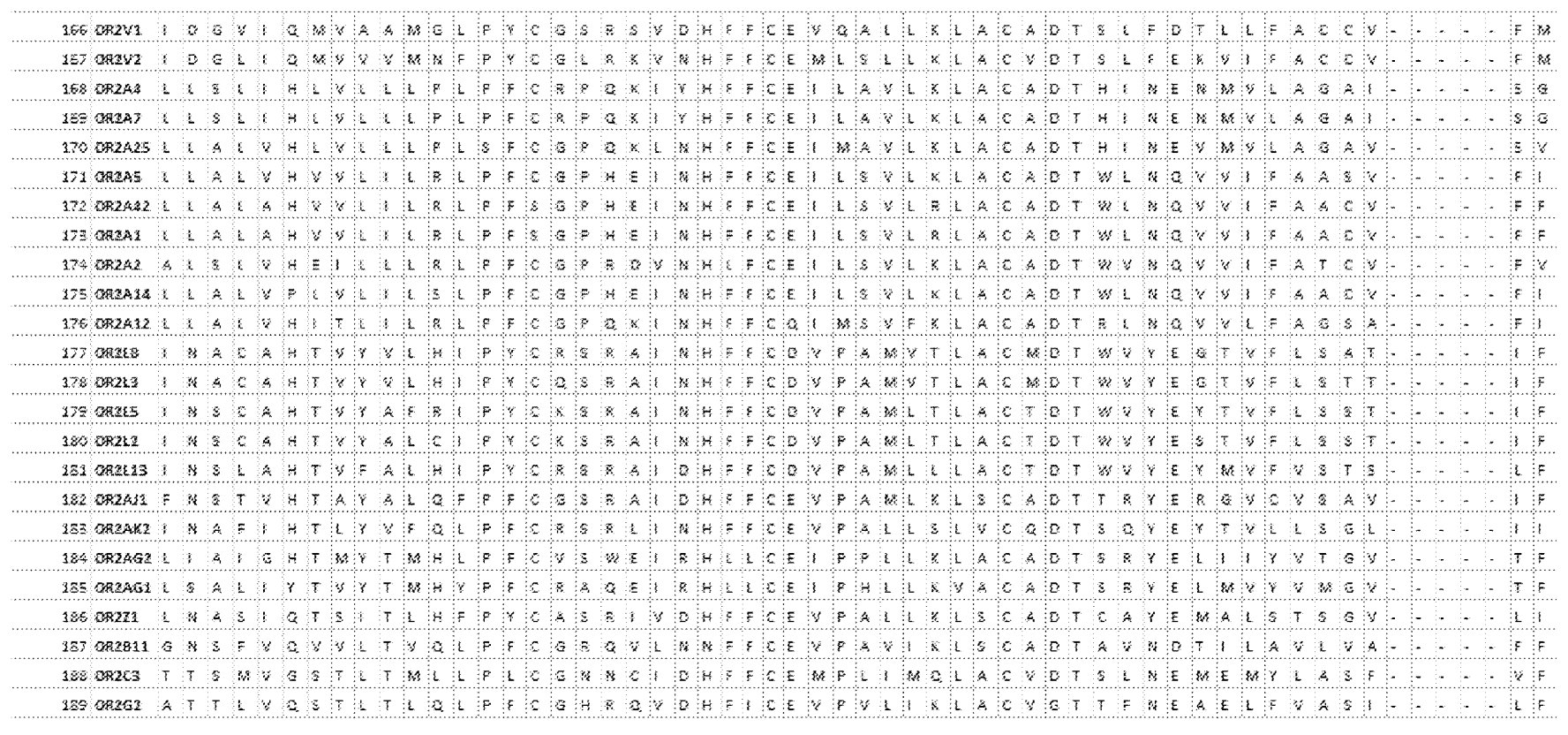
Figure 19:
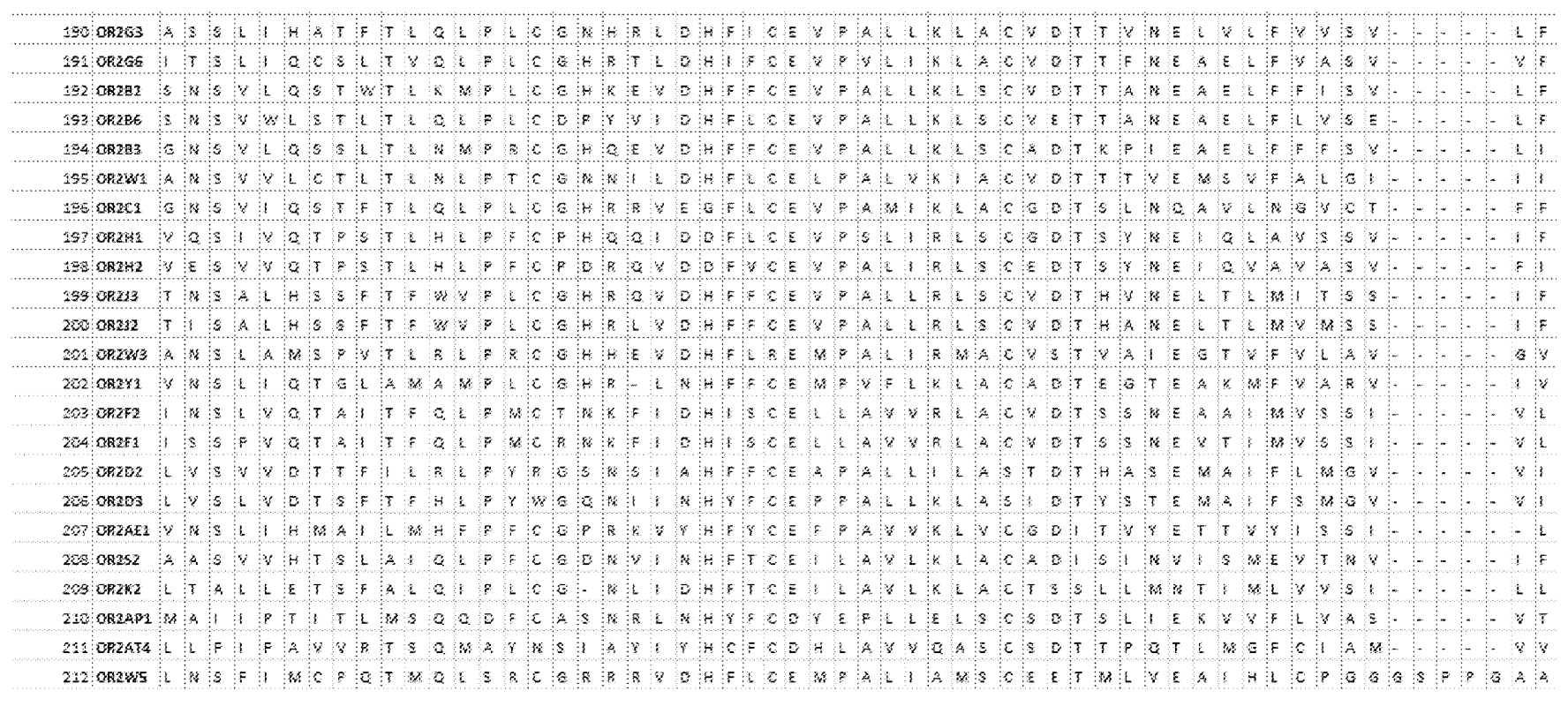
Figure 19:
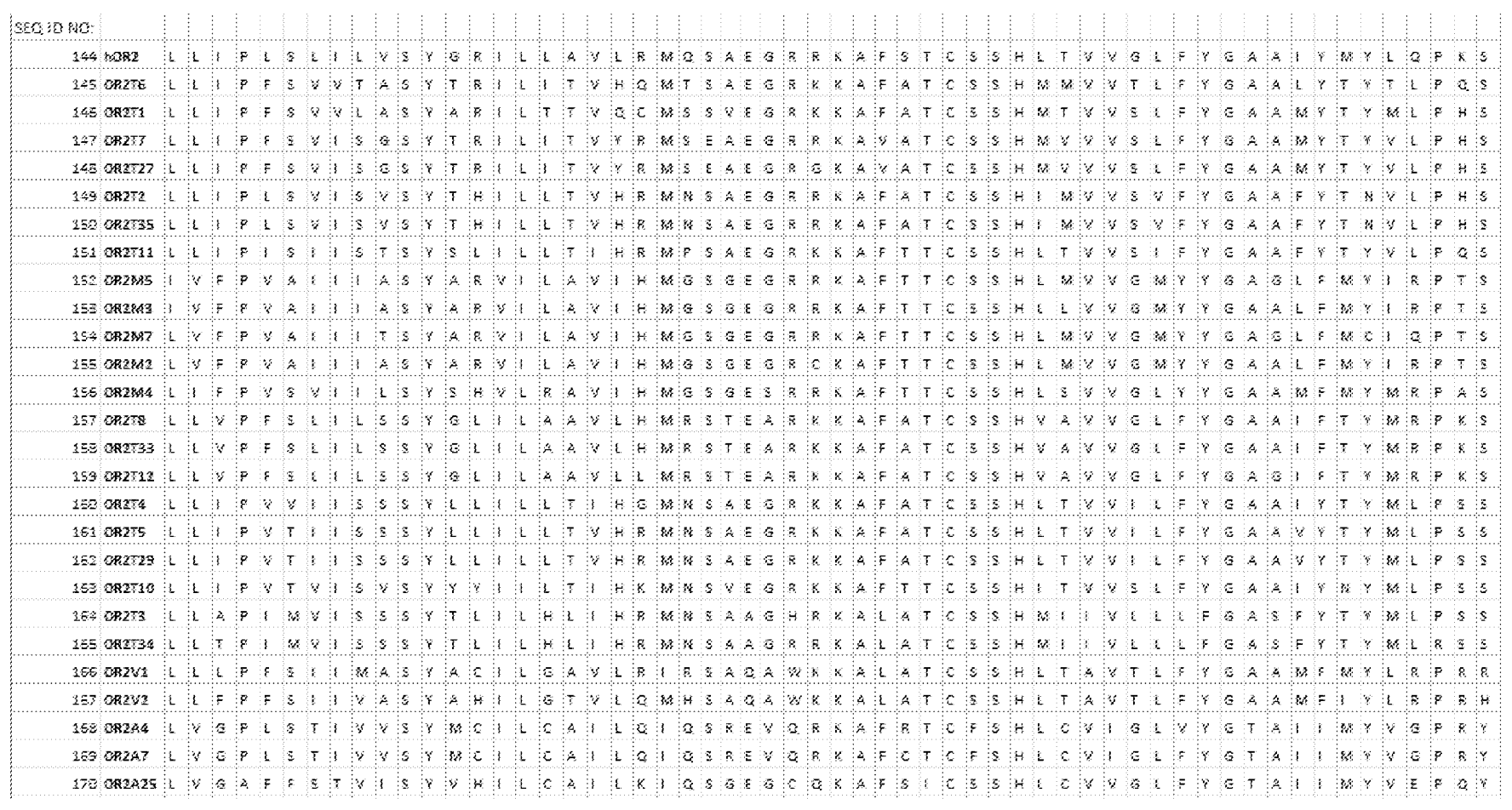
Figure 19:
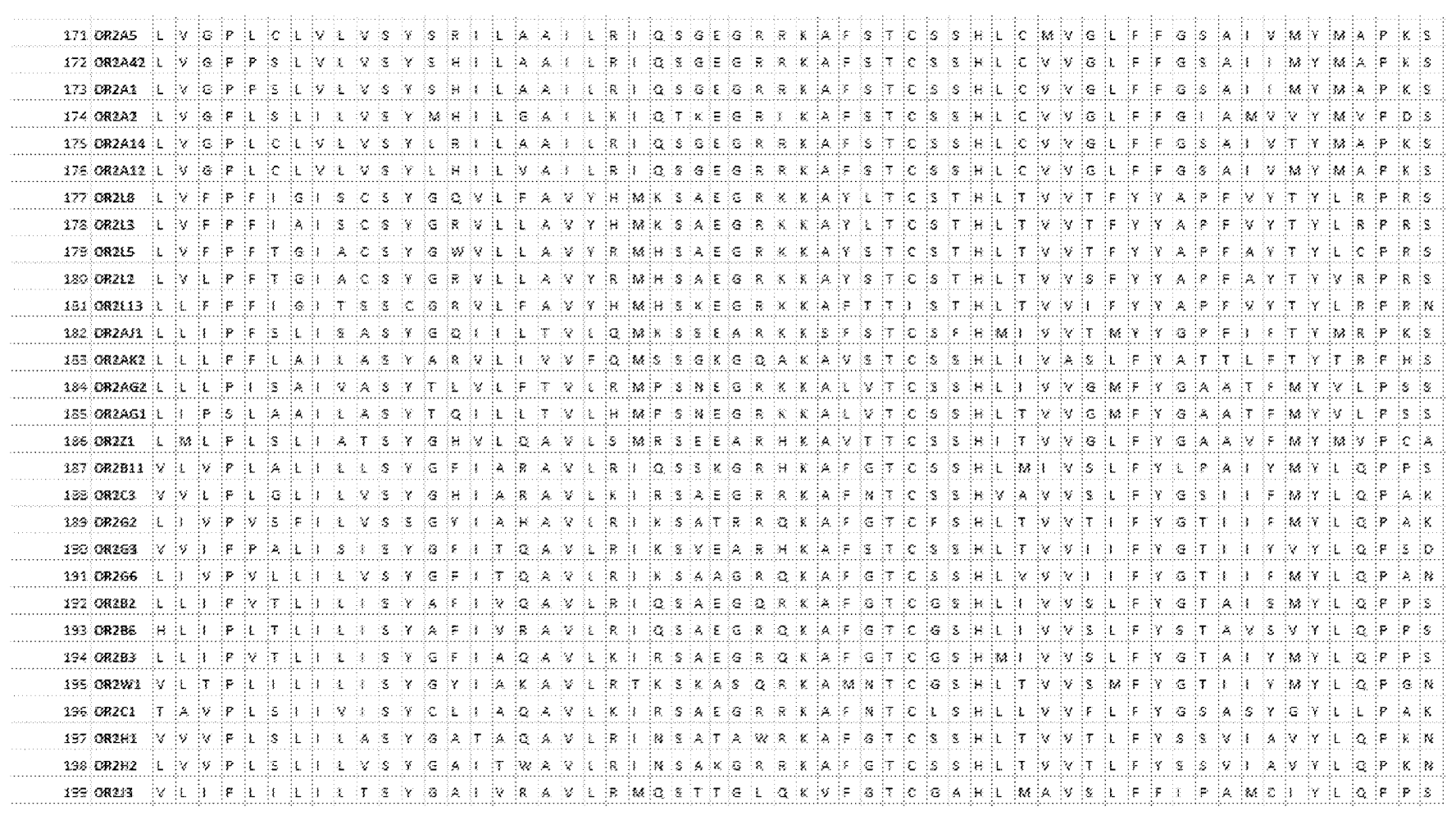
Figure 19:
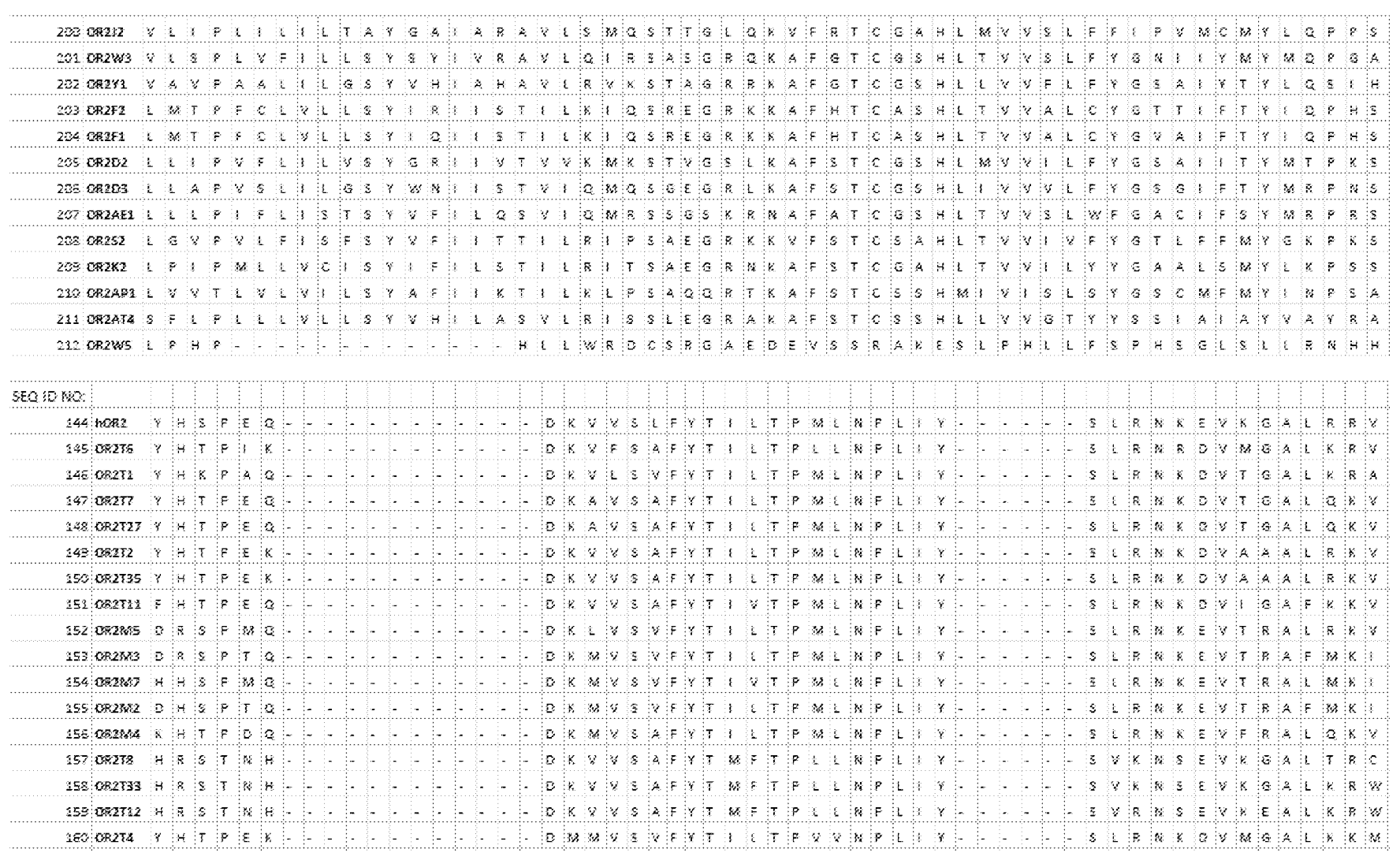
Figure 19:
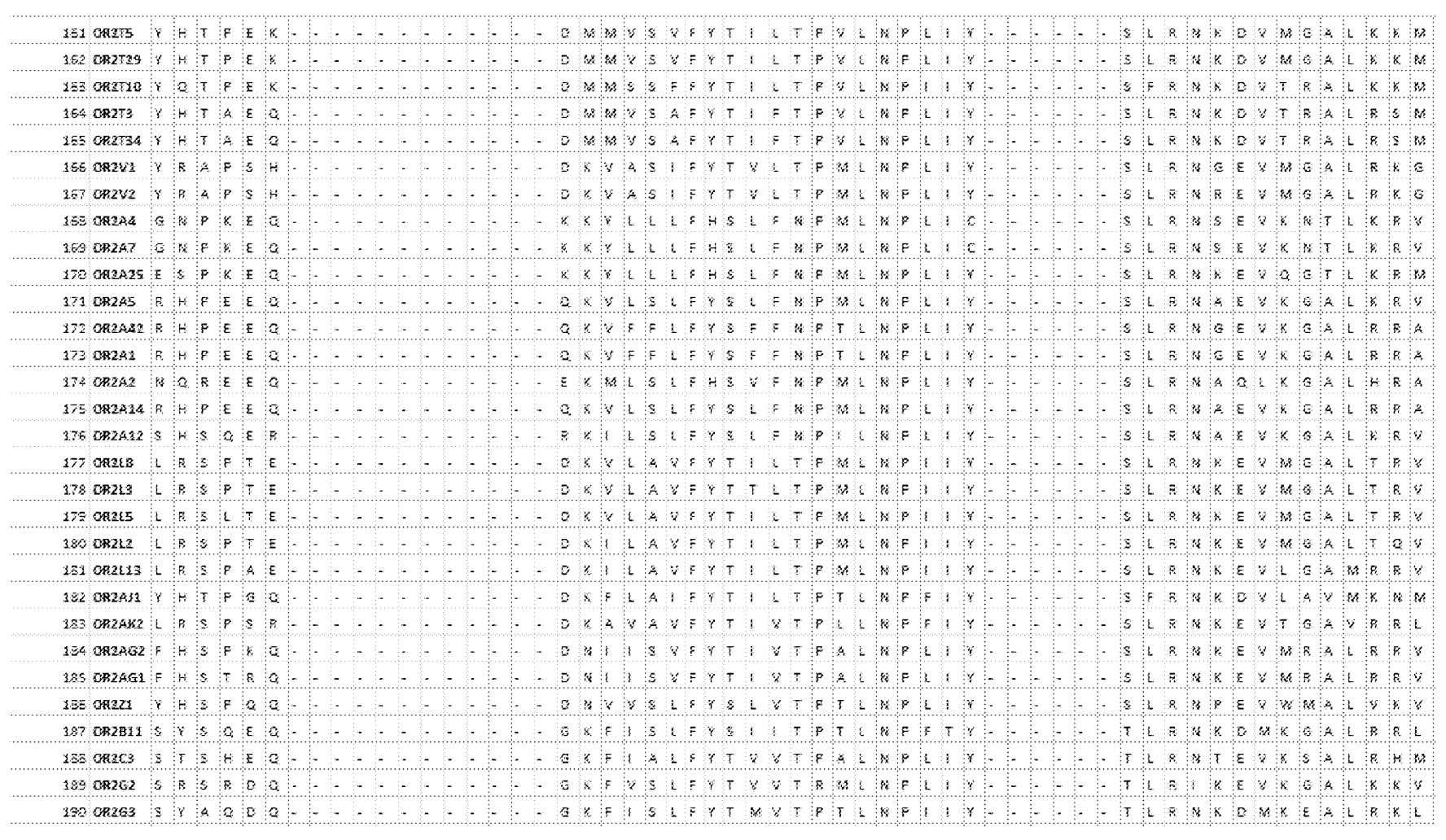
Figure 19:
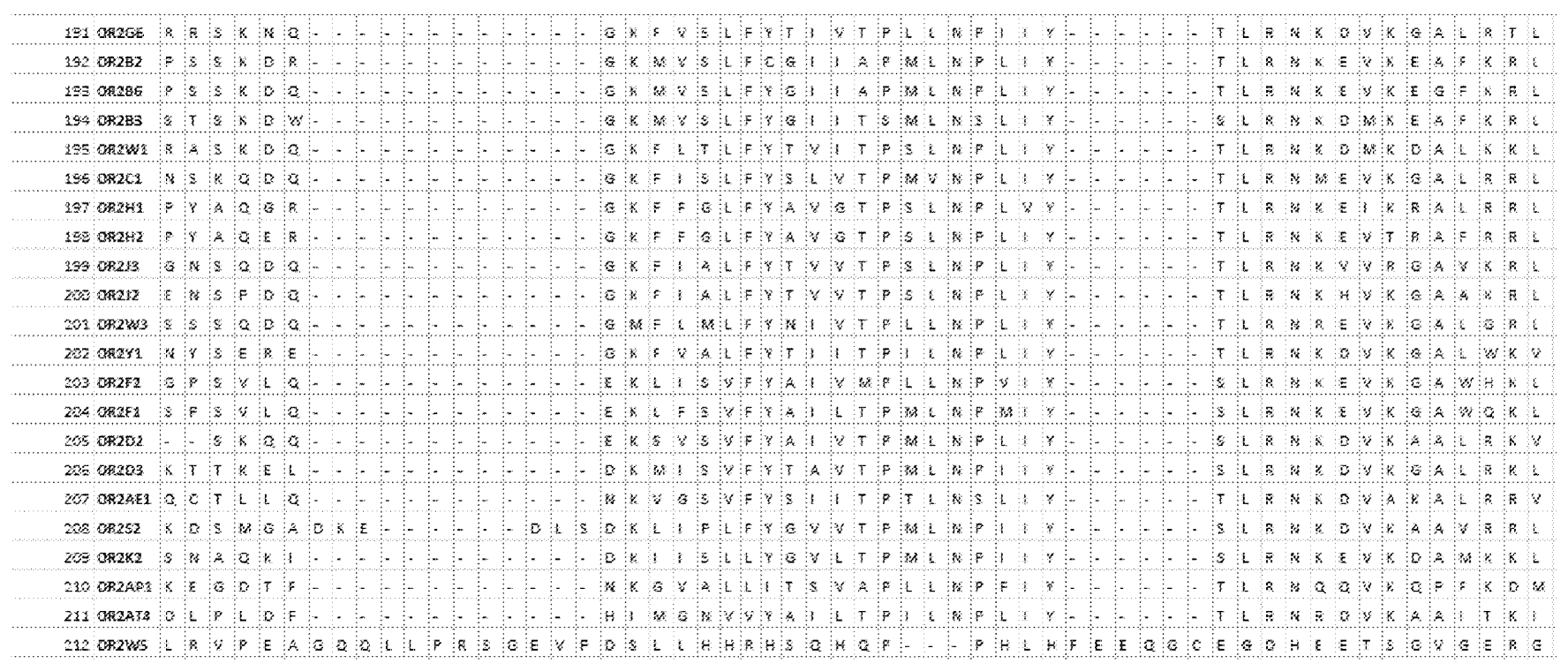
Figure 19:
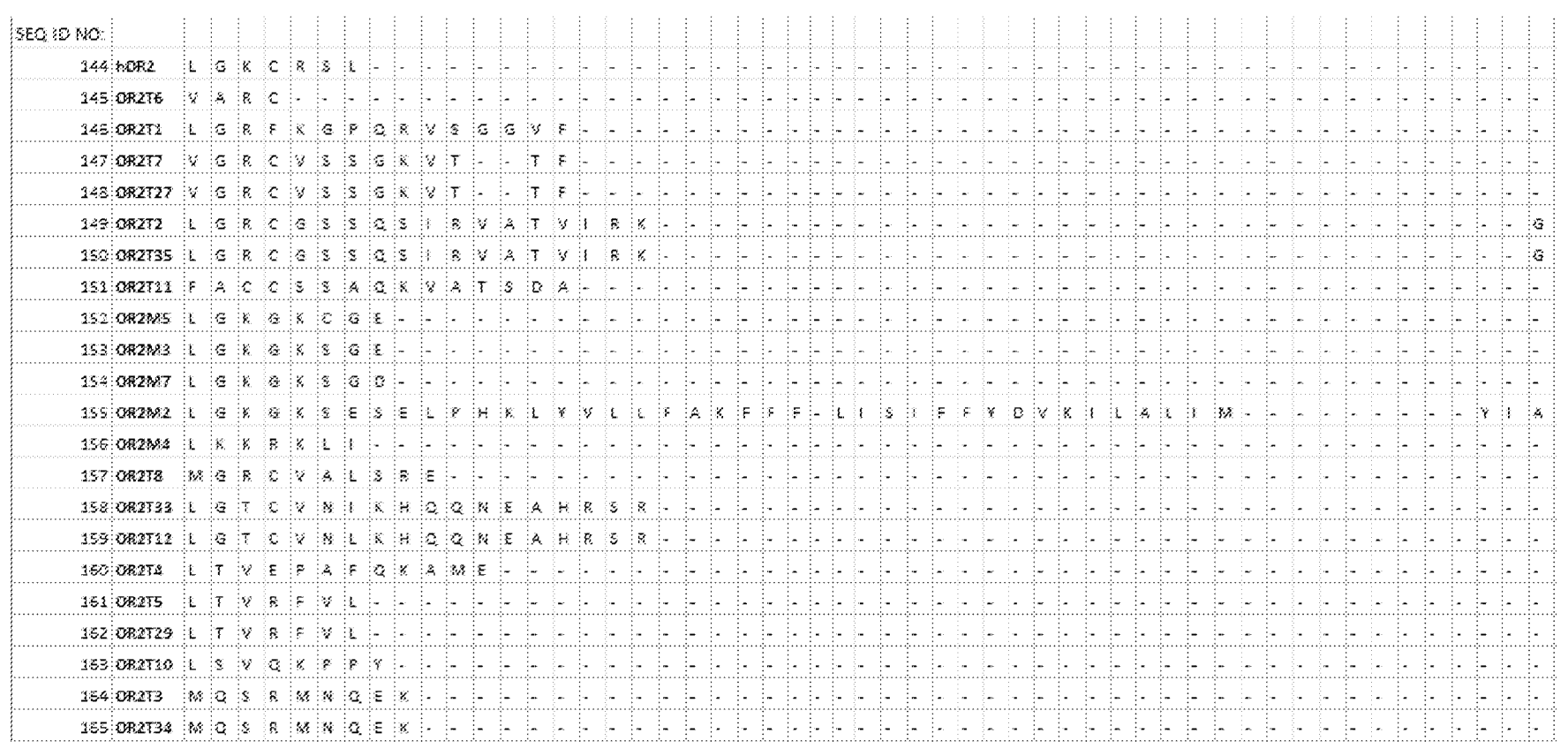
Figure 19:
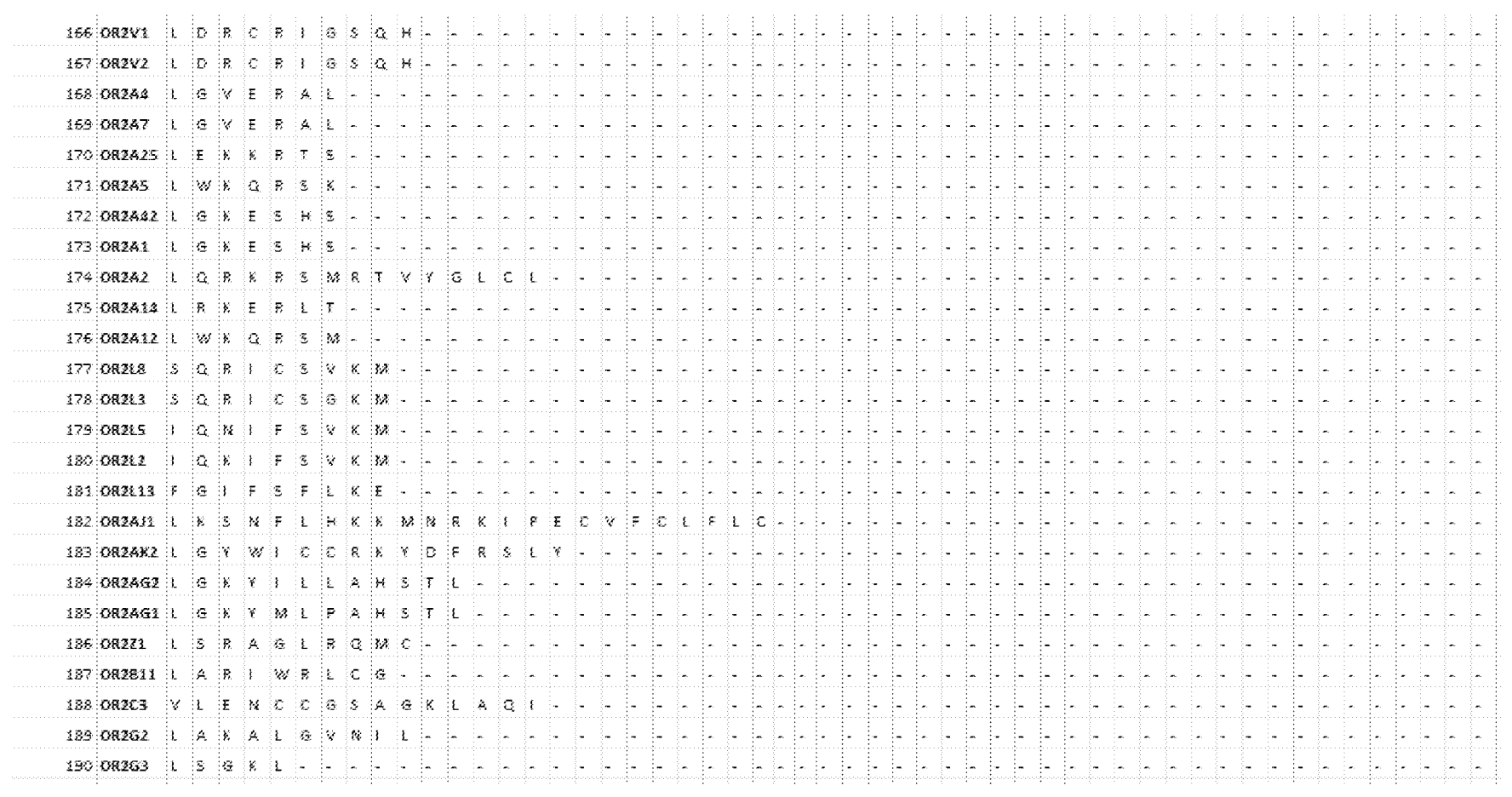
Figure 19:
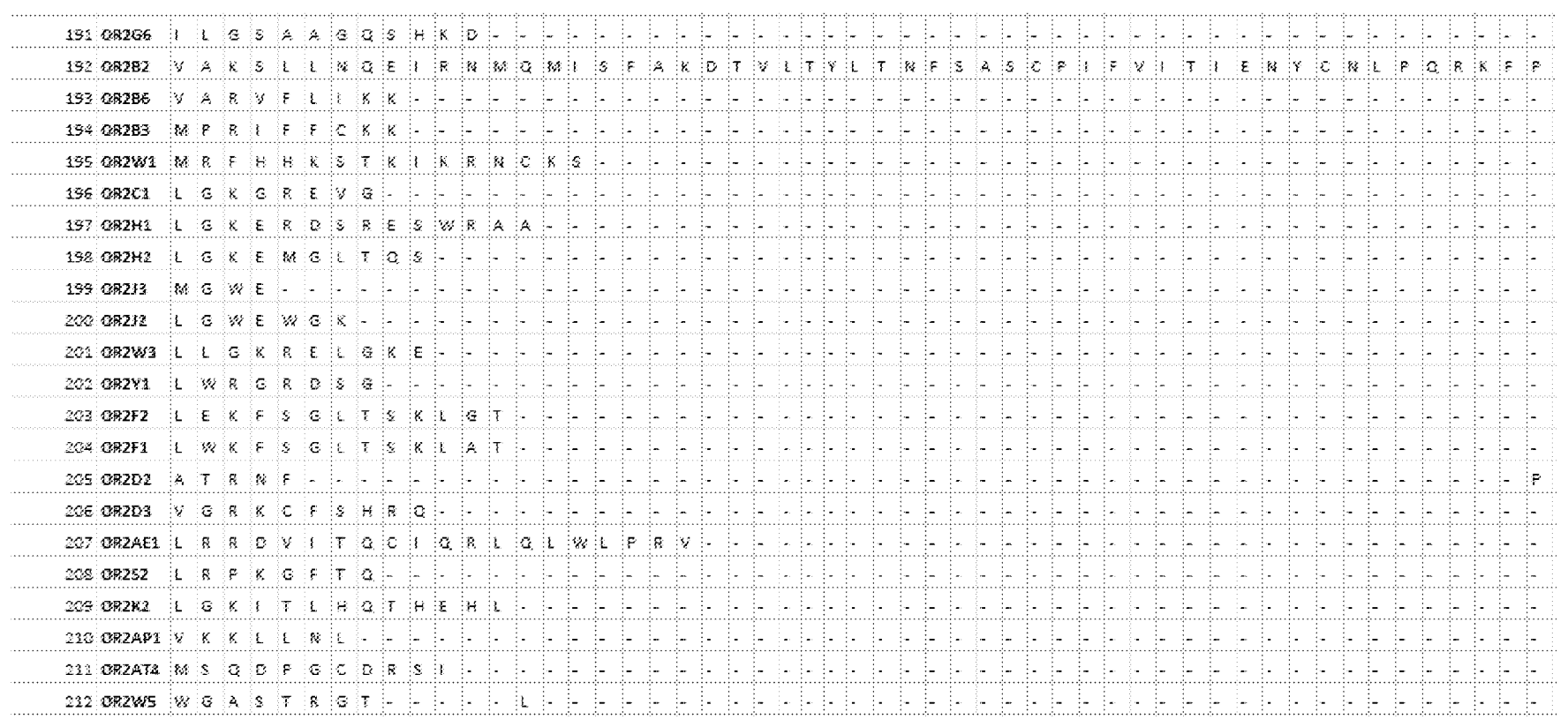
Figure 21:
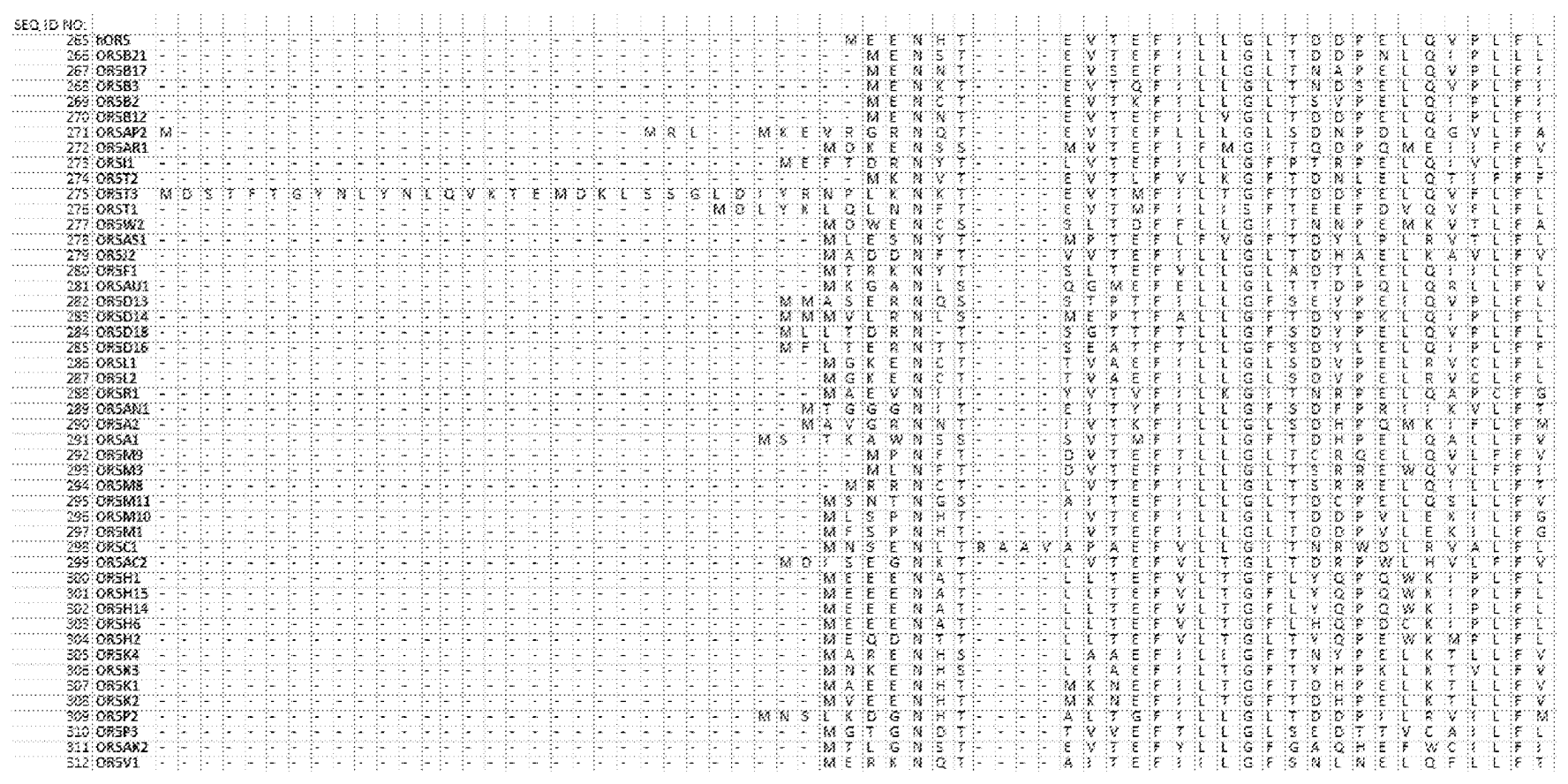
Figure 21:
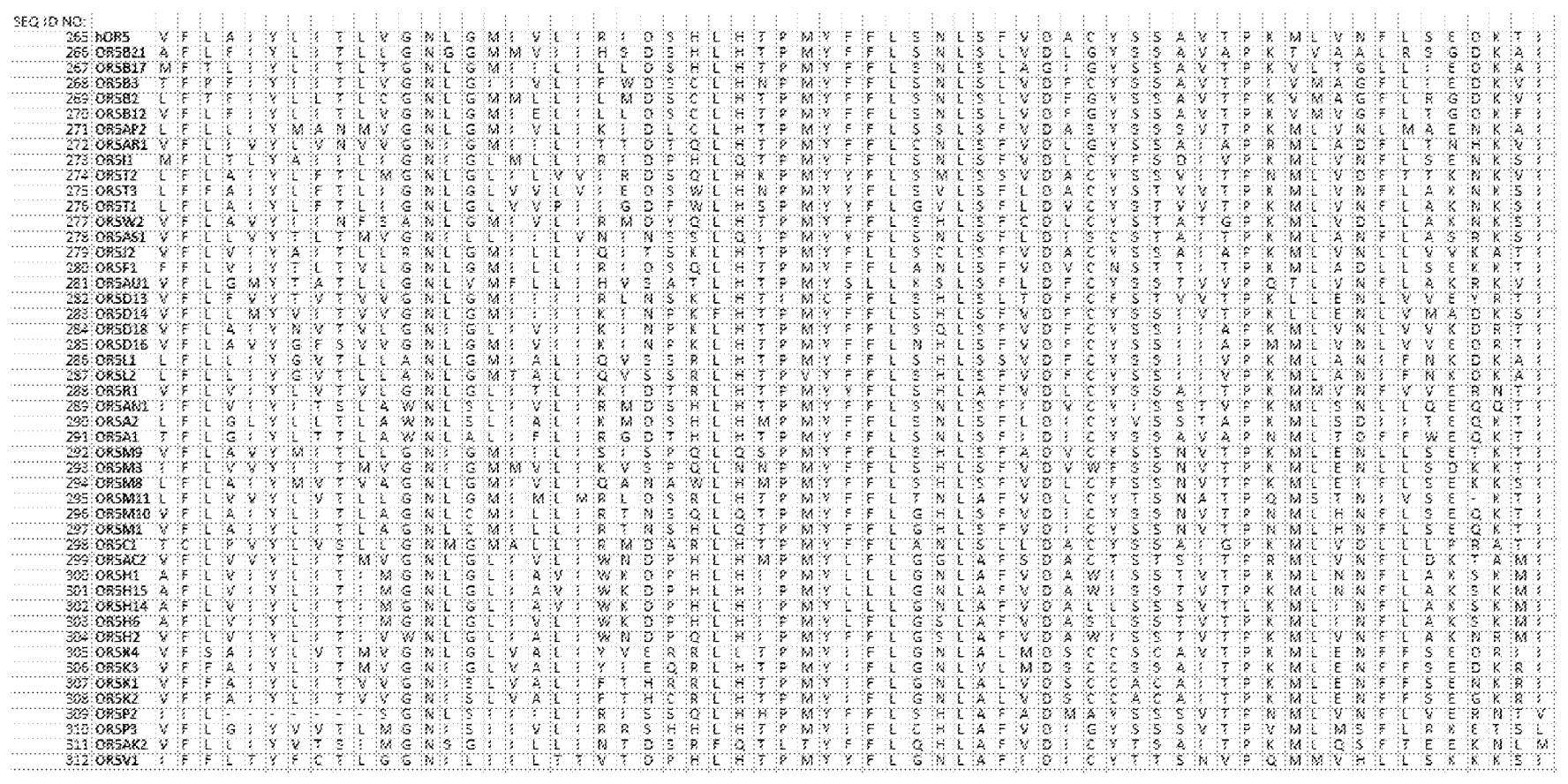
Figure 21:
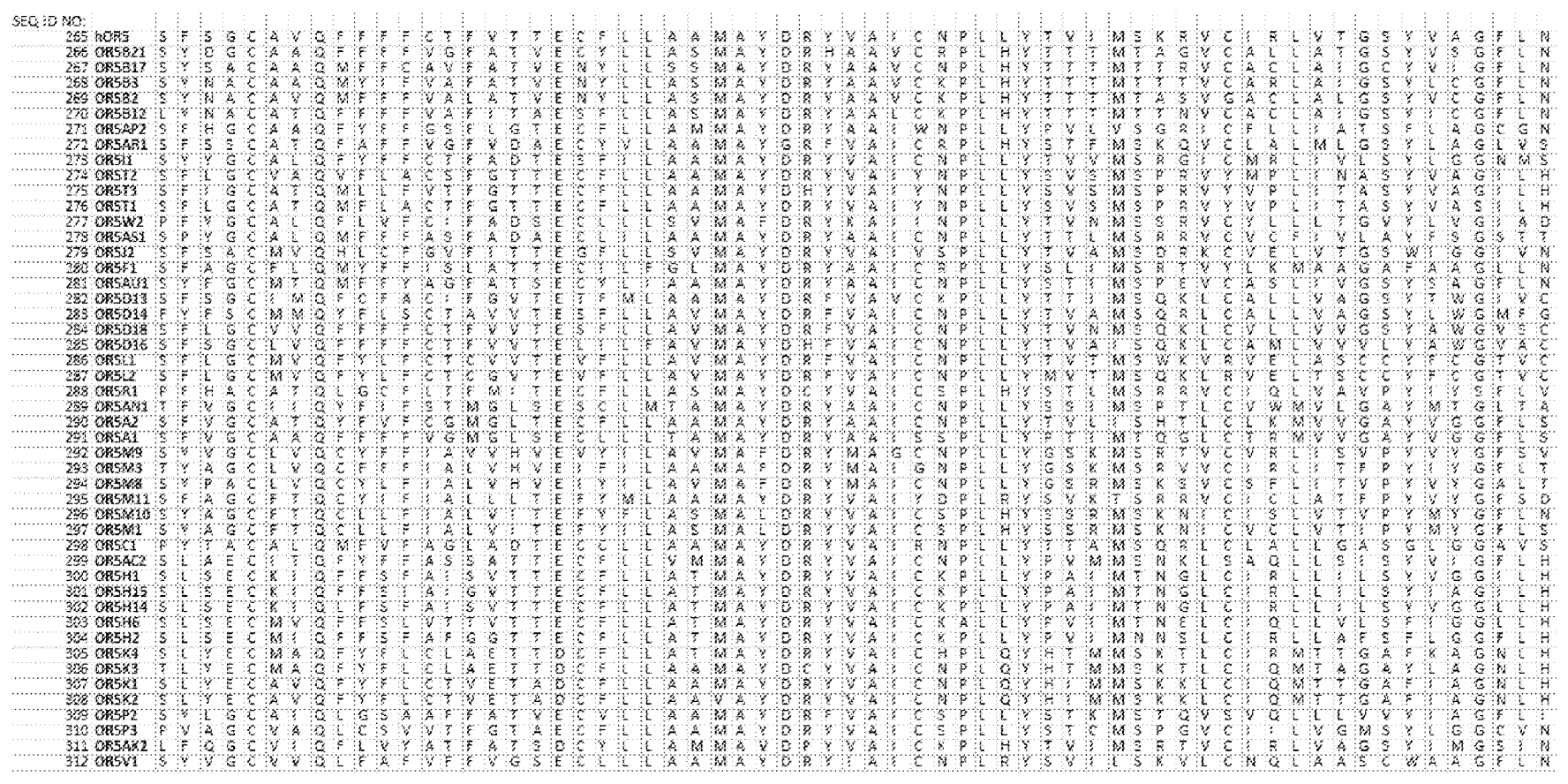
Figure 21:
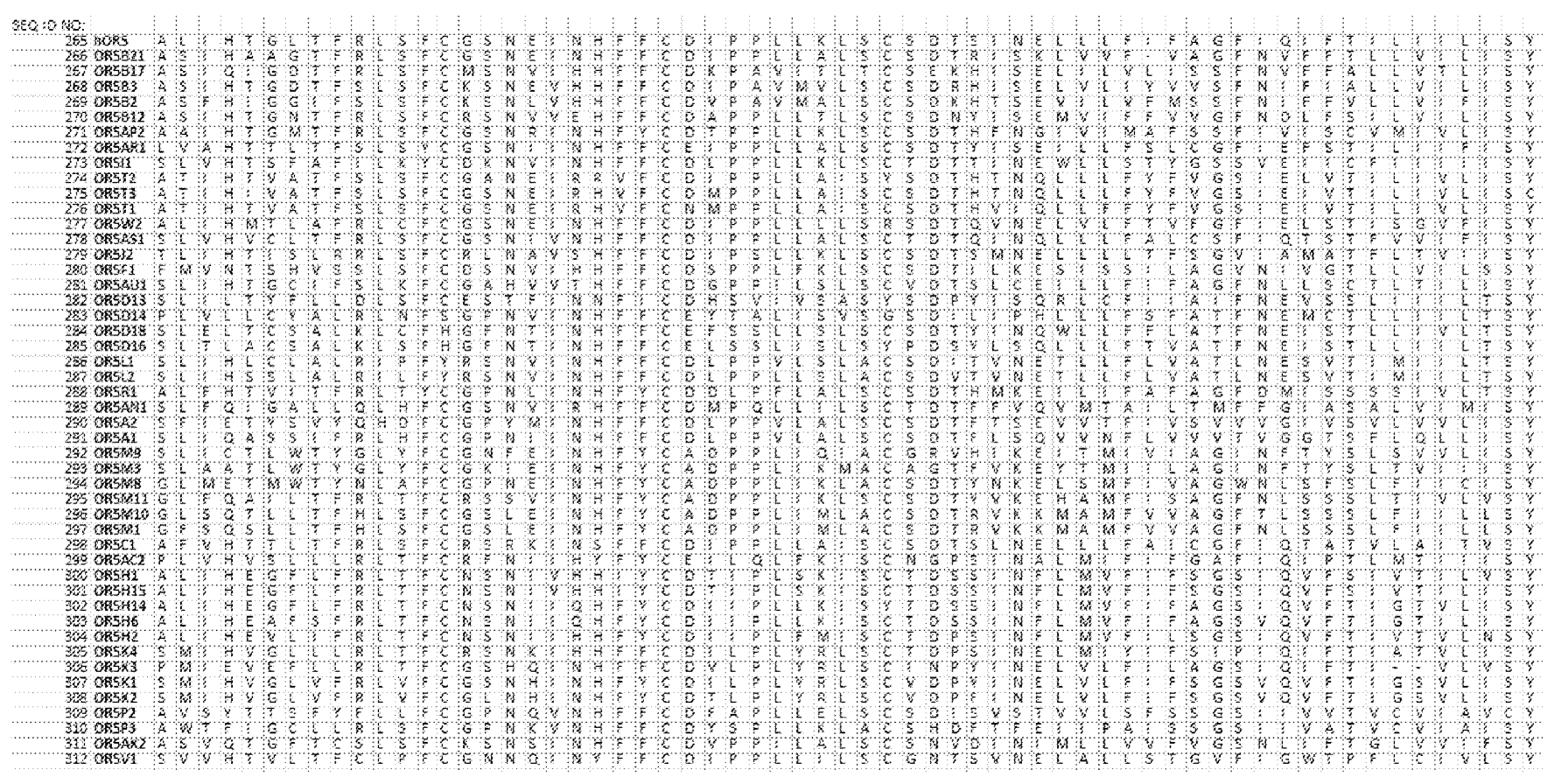
Figure 21:
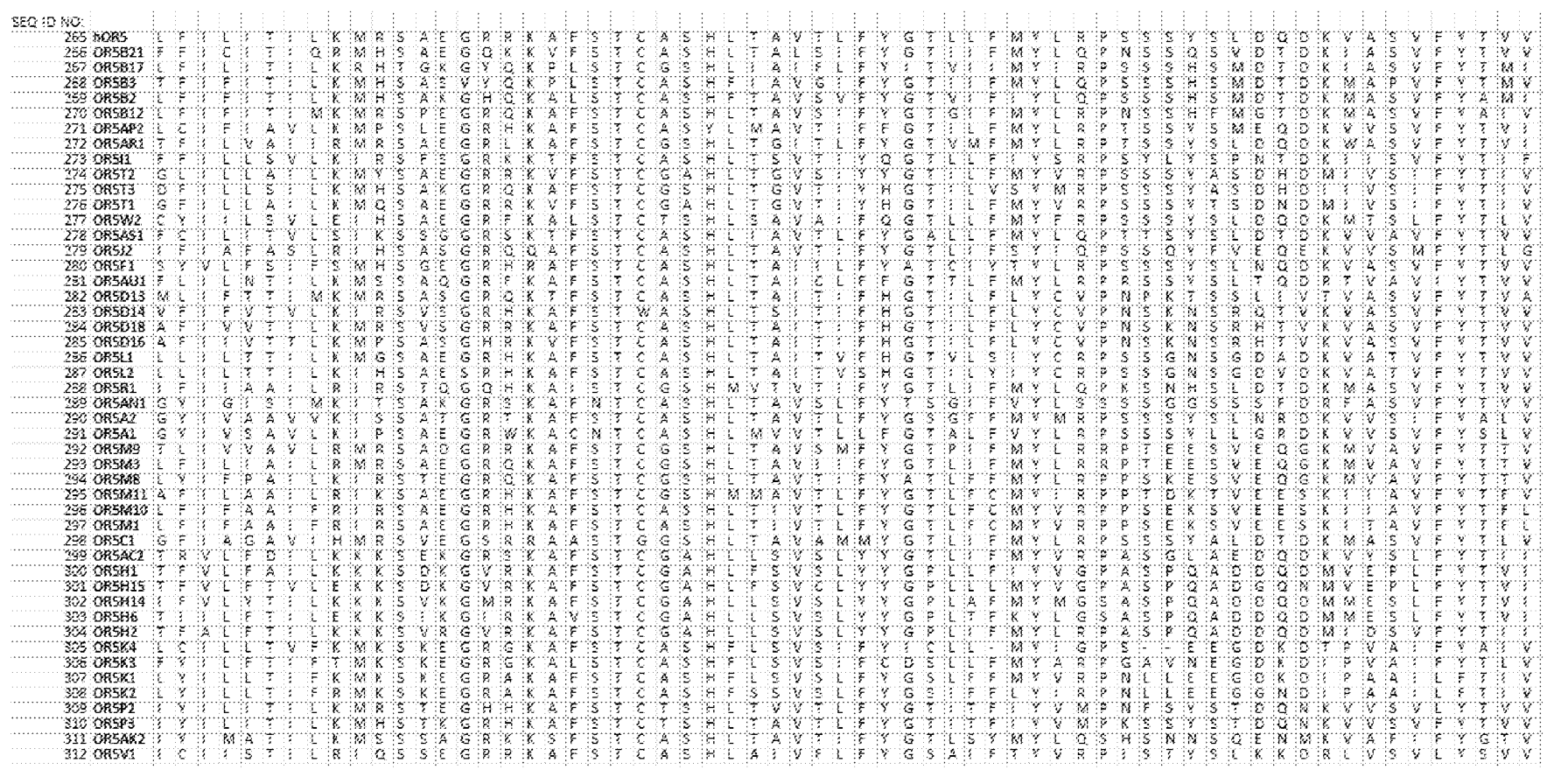
Figure 21:
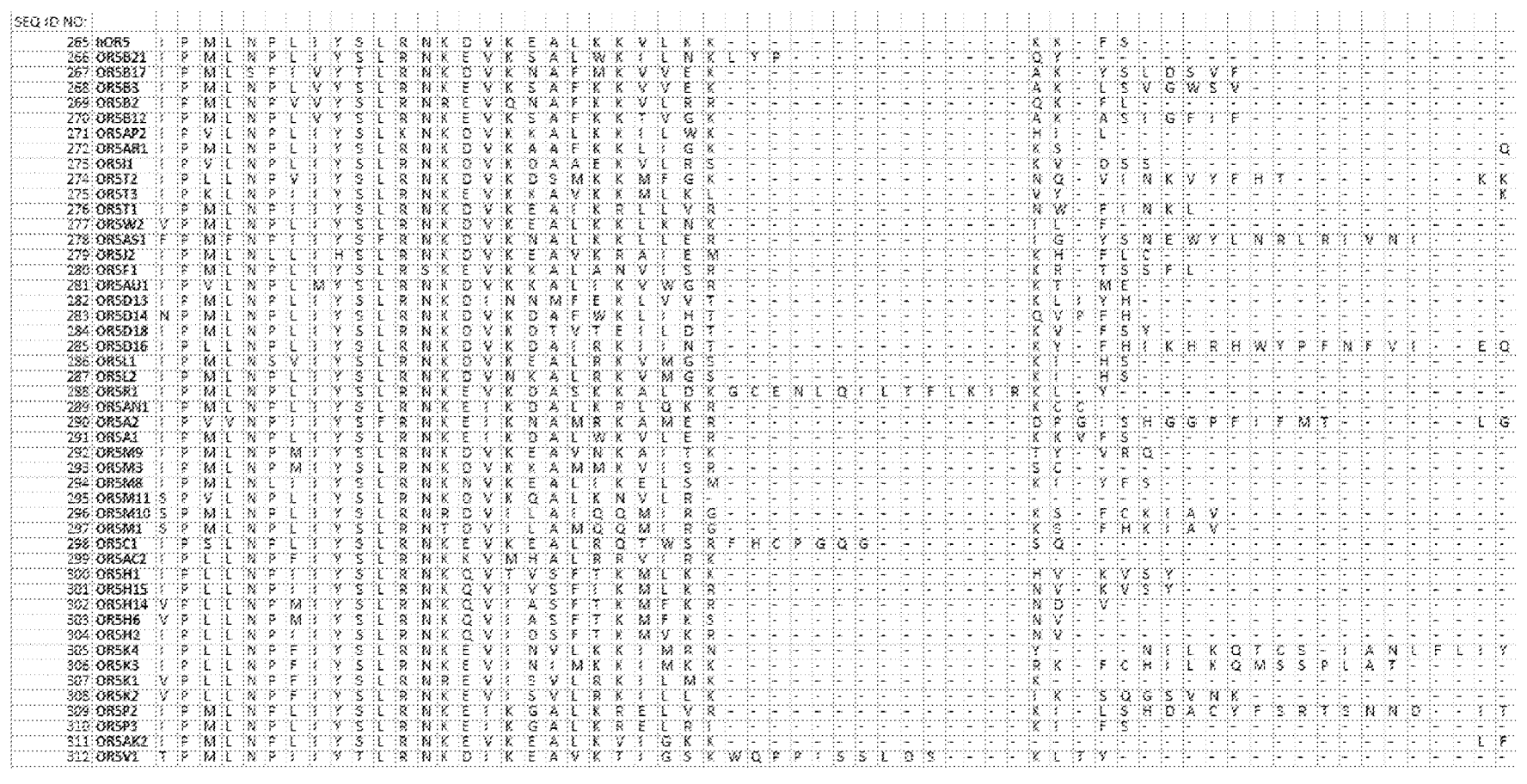
Figure 22:
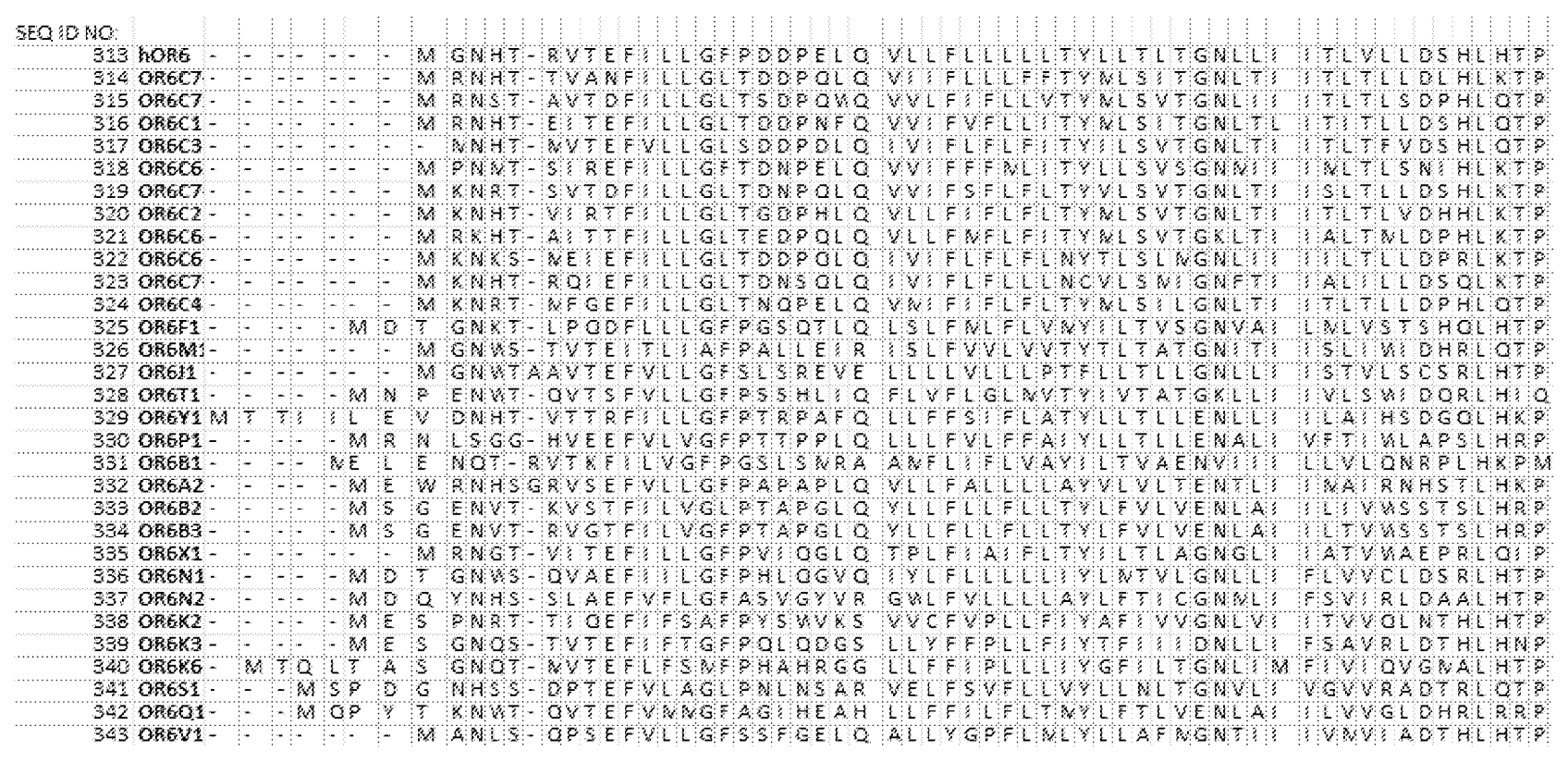
Figure 22:
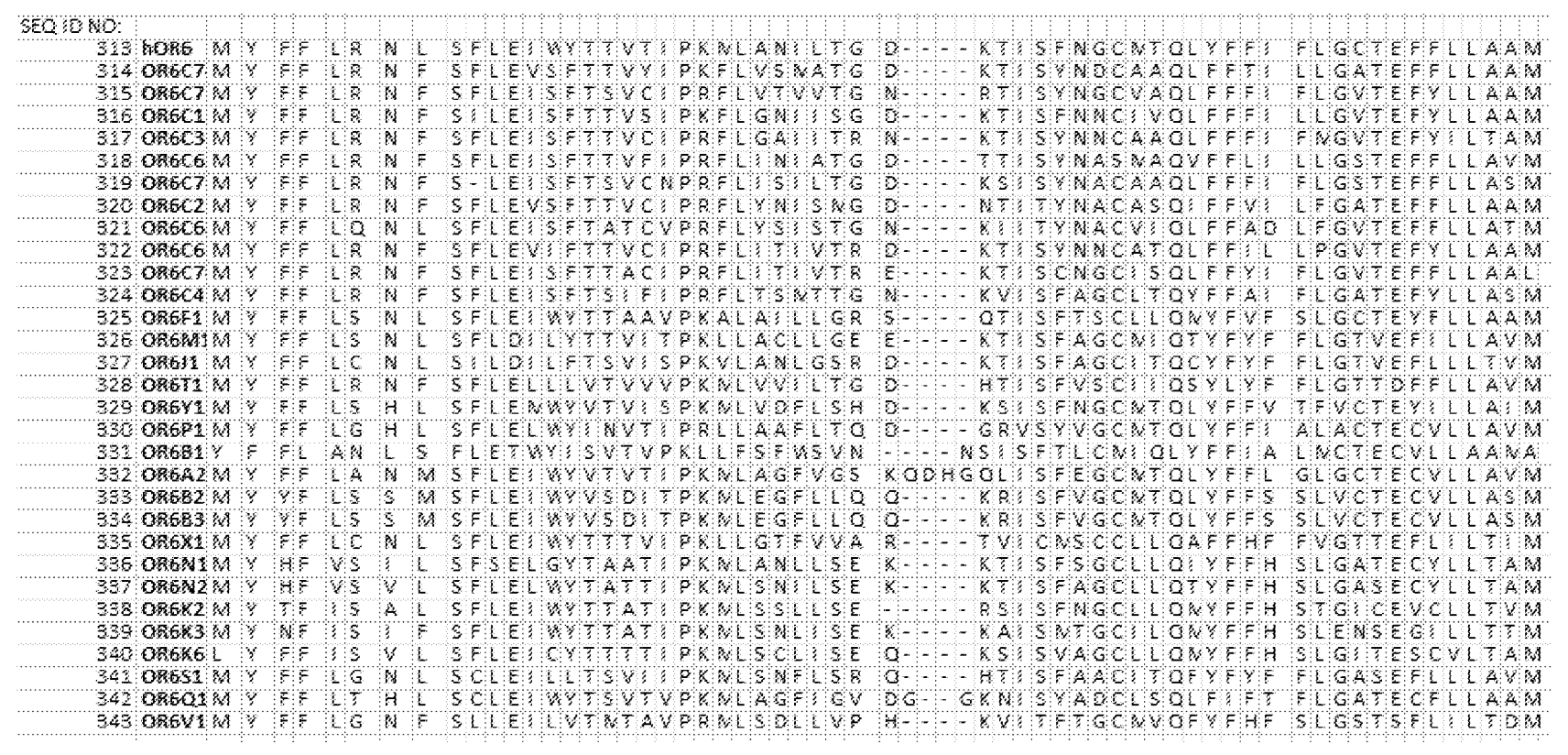
Figure 22:
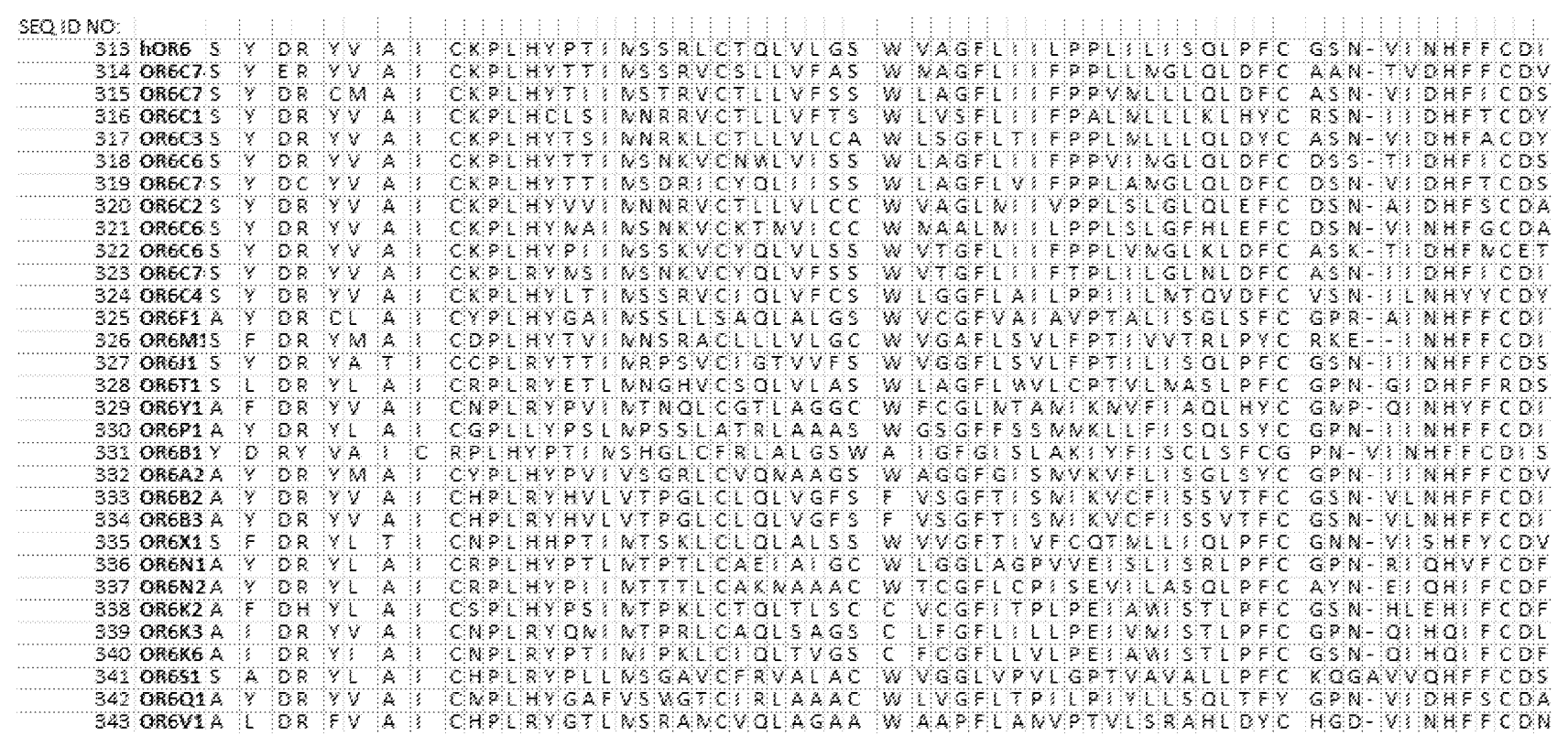
Figure 22:
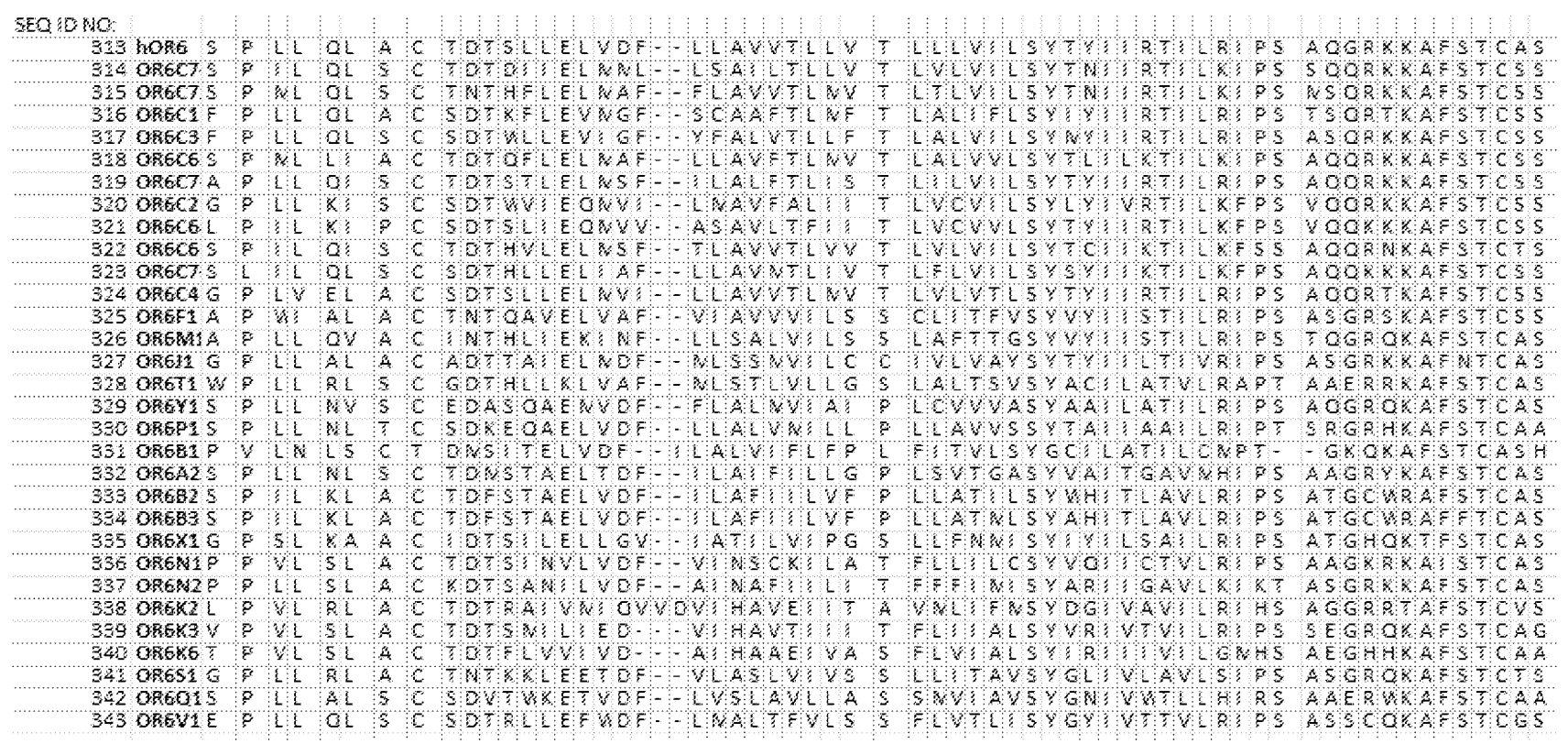
Figure 22:
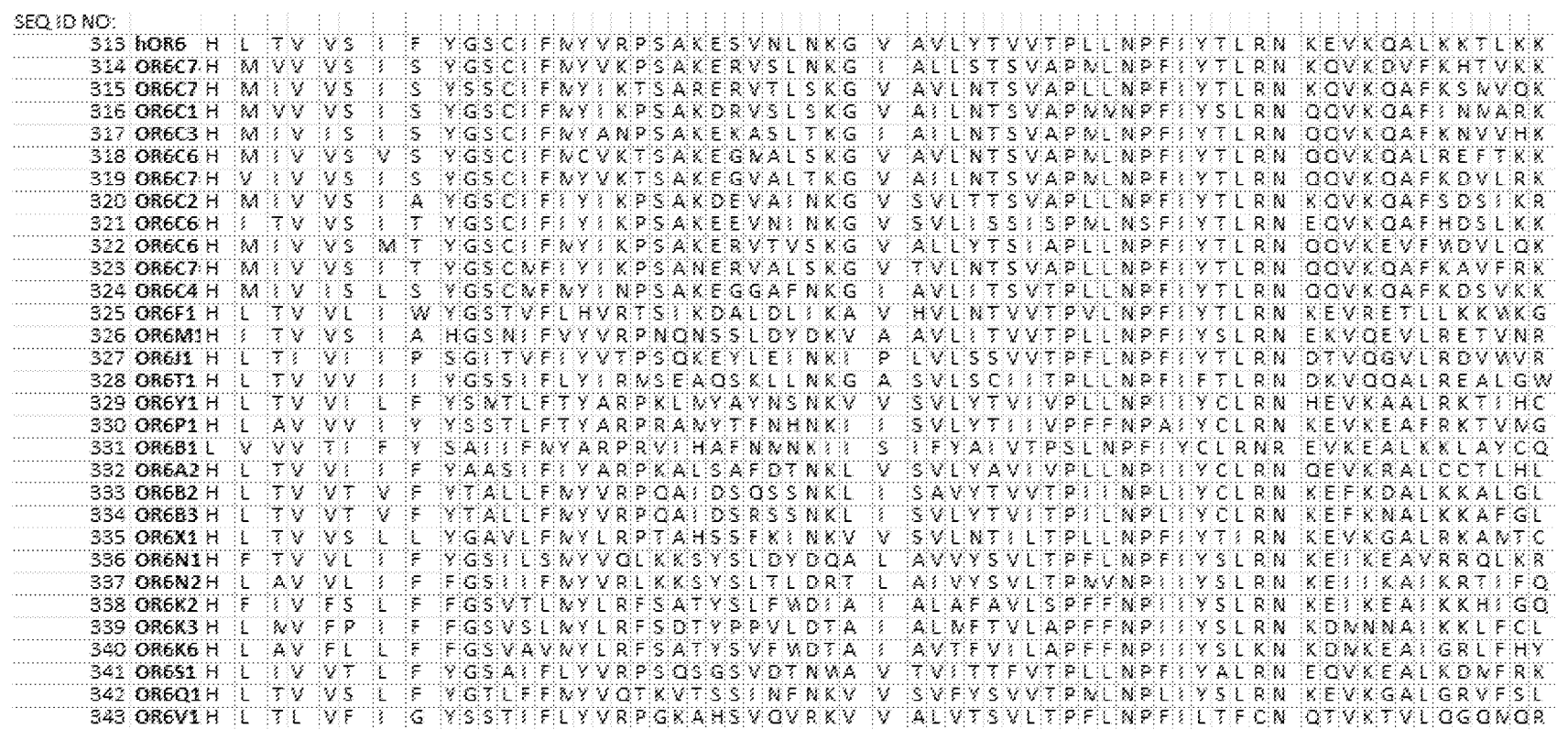
Figure 22:
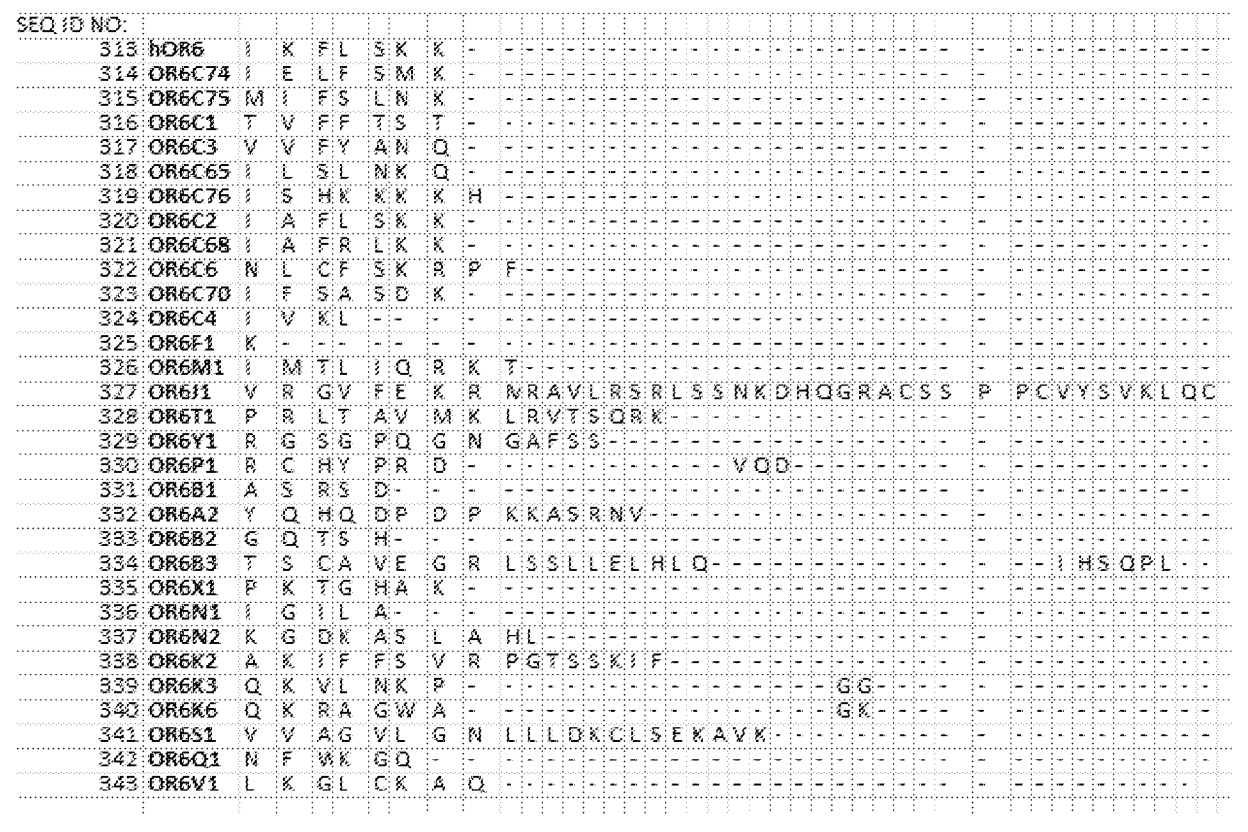

FIGS. 14-22. Alignment and generation of consensus amino acid sequences for human OR family 1, human OR family 2, human OR family 4, human OR family 5, human OR family 6, human OR family 8, human OR family 10, human OR family 51, and human OR family 52.

DETAILED DESCRIPTION OF THE INVENTION

The olfactory system represents one of the oldest sensory modalities in the phylogenetic history of mammals. Olfaction is less developed in humans than in other mammals such as rodents. As a chemical sensor, the olfactory system detects food and influences social and sexual behavior. The specialized olfactory epithelial cells characterize the only group of neurons capable of regeneration. Activation occurs when odiferous molecules come in contact with specialized processes known as the olfactory vesicles. Within the nasal cavity, the turbinates or nasal conchae serve to direct the inspired air toward the olfactory epithelium in the upper posterior region. This area (only a few centimeters wide) contains more than 100 million olfactory receptor cells. These specialized epithelial cells give rise to the olfactory vesicles containing kinocilia, which serve as sites of stimulus transduction.

There are three specialized neural systems are present within the nasal cavities in humans: 1) the main olfactory system (cranial nerve I), 2) trigeminal somatosensory system (cranial nerve V), 3) the nervus terminalis (cranial nerve 0). CN I mediates odor sensation. It is responsible for determining flavors. CN V mediates somatosensory sensations, including burning, cooling, irritation, and tickling. CN 0 is a ganglionated neural plexus. It spans much of the nasal mucosa before coursing through the cribriform plate to enter the forebrain medial to the olfactory tract. The exact function of the nervus terminalis is unknown in humans.

The olfactory neuroepithelium is a pseudostratified columnar epithelium. The specialized olfactory epithelial cells are the only group of neurons capable of regeneration. The olfactory epithelium is situated in the superior aspect of each nostril, including cribriform plate, superior turbinate, superior septum, and sections of the middle turbinate. It harbors sensory receptors of the main olfactory system and some CN V free nerve endings. The olfactory epithelium loses its general homogeneity postnatally, and as early as the first few weeks of life metaplastic islands of respiratory-like epithelium appear. The metaplasia increases in extent throughout life. It is presumed that this process is the result of insults from the environment, such as viruses, bacteria, and toxins.

There are 6 distinct cells types in the olfactory neuroepithelium: 1) bipolar sensory receptor neurons, 2) microvillar cells, 3) supporting cells, 4) globose basal cells, 5) horizontal basal cells, 6) cells lining the Bowman's glands. There are approximately 6,000,000 bipolar neurons in the adult olfactory neuroepithelium. They are thin dendritic cells with rods containing cilia at one end and long central processes at the other end forming olfactory fila. The olfactory receptors are located on the ciliated dendritic ends. The unmyelinated axons coalesce into 40 bundles, termed olfactory fila, which are ensheathed by Schwann-like cells. The fila transverses the cribriform plate to enter the anterior cranial fossa and constitute CN I. Microvillar cells are near the surface of the neuroepithelium, but the exact functions of these cells are unknown. Supporting cells are also at the surface of the epithelium. They join tightly with neurons and microvillar cells. They also project microvilli into the mucus. Their functions include insulating receptor cells from one another, regulating the composition of the mucus, deactivating odorants, and protecting the epithelium from foreign agents. The basal cells are located near the basement membrane, and are the progenitor cells from which the other cell types arise. The Bowman's glands are a major source of mucus within the region of the olfactory epithelium.

The odorant receptors are located on the cilia of the receptor cells. Each receptor cell expresses a single odorant receptor gene. There are approximately 1,000 classes of receptors at present. The olfactory receptors are linked to the stimulatory guanine nucleotide binding protein Golf. When stimulated, it can activate adenylate cyclase to produce the second messenger cAMP, and subsequent events lead to depolarization of the cell membrane and signal propagation.

Although each receptor cell only expresses one type of receptor, each cell is electrophysiologically responsive to a wide but circumscribed range of stimuli. This implies that a single receptor accepts a range of molecular entities.

The olfactory bulb is located on top of the cribriform plate at the base of the frontal lobe in the anterior cranial fossa. It receives thousands of primary axons from olfactory receptor neurons. Within the olfactory bulb, these axons synapse with a much smaller number of second order neurons which form the olfactory tract and project to olfactory cortex. The olfactory cortex includes the frontal and temporal lobes, thalamus, and hypothalamus.

As noted, mammalian odorant receptors (ORs) are diverse members of G-protein coupled receptors abundantly expressed in the olfactory cilia membrane. The vast majority of ORs show poor cell surface expression in non-olfactory cells due to endoplasmic reticulum (ER) retention. Experiments conducted during the course of developing embodiments for the present invention identified critical amino acid residues involved in cell surface expression of ORs in heterologous cells. It was found that an amino acid residue located in the middle region of transmembrane domain 4, is critical for cell surface expression of some ORs. Molecular dynamics simulations suggested that structural instability is associated with poor cell surface expression. For a more comprehensive analysis, experiments were conducted with a large screening and identified 66 critical sites scattered throughout the receptors associated with cell surface expression. Inconsistent with the OR-specific ER retention signals, divergence from the most frequently used amino acid residues in the vast majority of these sites is associated with poor cell surface expression. To directly test importance of conserved residues, nine "consensus ORs" based on the most frequently used residues for a given human OR subfamily were synthesized and tested. Most of the consensus ORs show high cell surface expression levels that surpass any tested natural ORs in heterologous cells. Furthermore, some consensus ORs show specific responses to tested odorants, indicating proper folding. Such results indicate the importance of conserved residues in complex regulation of OR trafficking.

Accordingly, the present invention relates to novel synthetic odorant receptors capable of cell surface localization upon cellular expression. Specifically, the present invention provides synthetic odorant receptors having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family. Additionally, the present invention provides methods of use, methods of synthesis, and cell lines expressing one or more of such novel synthetic odorant receptors.

Indeed, the present invention provides novel synthetic odorant receptors having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family.

Accordingly, the present invention provides nucleic acids encoding synthetic odorant receptor genes, homologs, variants (e.g., polymorphisms and mutants), including but not limited to, those encoding odorant receptors having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family.

In some embodiments, the nucleotide sequences for the synthetic odorant receptors may be engineered in order to alter a coding sequence for a variety of reasons, including but not limited to, alterations which modify the cloning, processing and/or expression of the gene product. For example, mutations may be introduced using techniques that are well known in the art (e.g., site-directed mutagenesis to insert new restriction sites, to alter glycosylation patterns, to change codon preference, etc.).

In some embodiments of the present invention, the nucleotide sequences for the synthetic odorant receptors may be extended utilizing the nucleotide sequence in various methods known in the art to detect upstream sequences such as promoters and regulatory elements. For example, it is contemplated that restriction-site polymerase chain reaction (PCR) will find use in the present invention. This is a direct method that uses universal primers to retrieve unknown sequence adjacent to a known locus (Gobinda et al., PCR Methods Applic., 2:318-22 (1993); herein incorporated by reference in its entirety). First, genomic DNA is amplified in the presence of a primer to a linker sequence and a primer specific to the known region. The amplified sequences are then subjected to a second round of PCR with the same linker primer and another specific primer internal to the first one. Products of each round of PCR are transcribed with an appropriate RNA polymerase and sequenced using reverse transcriptase.

In another embodiment, inverse PCR can be used to amplify or extend sequences using divergent primers based on a known region (Triglia et al., Nucleic Acids Res., 16:8186 [1988]). The primers may be designed using Oligo 4.0 (National Biosciences Inc, Plymouth Minn.), or another appropriate program, to be 22-30 nucleotides in length, to have a GC content of 50% or more, and to anneal to the target sequence at temperatures about 68-72° C. The method uses several restriction enzymes to generate a suitable fragment in the known region of a gene. The fragment is then circularized by intramolecular ligation and used as a PCR template. In still other embodiments, walking PCR is utilized. Walking PCR is a method for targeted gene walking that permits retrieval of unknown sequence (Parker et al., Nucleic Acids Res., 19:3055-60 [1991]). The PROMOTER-FINDER kit (Clontech) uses PCR, nested primers and special libraries to "walk in" genomic DNA. This process avoids the need to screen libraries and is useful in finding intron/exon junctions.

Preferred libraries for screening for full length cDNAs include mammalian libraries that have been size-selected to include larger cDNAs. Also, random primed libraries are preferred, in that they will contain more sequences that contain the 5' and upstream gene regions. A randomly primed library may be particularly useful in case where an oligo d(T) library does not yield full-length cDNA. Genomic mammalian libraries are useful for obtaining introns and extending 5' sequence.

In other embodiments of the present invention, variants of the disclosed nucleotide sequences for the synthetic odorant receptors are provided. In preferred embodiments, variants generally produce altered mRNAs or polypeptides whose structure or function may or may not be altered. Any given gene may have none, one, or many variant forms. Common mutational changes that give rise to variants are generally ascribed to deletions, additions or substitutions of nucleic acids. Each of these types of changes may occur alone, or in combination with the others, and at the rate of one or more times in a given sequence.

In other embodiments, the present invention provides nucleotide sequences for the synthetic odorant receptors that encode synthetic odorant receptor polypeptides having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family. In preferred embodiments, the present invention provides a polypeptide encoded by a nucleic acid encoding a polypeptide having a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family and variants thereof that are at least 80% identical to such a polynucleotide sequence. In further embodiments, the protein has an amino acid sequence that is at least 90% (e.g., 95%, 98%, 99%, 99.9%) identical to a consensus amino acid sequence deduced from a plurality of odorant receptors within an odorant receptor family, wherein the consensus amino acid sequence represents the mostly frequently present amino acid residues for each amino acid position deduced from a plurality of odorant receptors within an odorant receptor family. Other embodiments of the present invention provide fragments, fusion proteins or functional equivalents of the synthetic odorant receptor proteins. In some embodiments, the present invention provides mutants of such synthetic odorant receptor polypeptides. In still other embodiments of the present invention, nucleic acid sequences corresponding to synthetic odorant receptor variants, homologs, and mutants may be used to generate recombinant DNA molecules that direct the expression of the synthetic odorant receptor variants, homologs, and mutants in appropriate host cells. In some embodiments of the present invention, the polypeptide may be a naturally purified product, in other embodiments it may be a product of chemical synthetic procedures, and in still other embodiments it may be produced by recombinant techniques using a prokaryotic or eukaryotic host (e.g., by bacterial, yeast, higher plant, insect and mammalian cells in culture). In some embodiments, depending upon the host employed in a recombinant production procedure, the polypeptide of the present invention may be glycosylated or may be non-glycosylated. In other embodiments, the polypeptides of the invention may also include an initial methionine amino acid residue.

In some embodiments, the consensus amino acid sequence is selected from SEQ ID Nos: 56, 14, 144, 213, 93 and 117.

The polynucleotides of the present invention may be employed for producing polypeptides by recombinant techniques. Thus, for example, the polynucleotide may be included in any one of a variety of expression vectors for expressing a polypeptide. In some embodiments of the present invention, vectors include, but are not limited to, chromosomal, nonchromosomal and synthetic DNA sequences (e.g., derivatives of SV40, bacterial plasmids, phage DNA; baculovirus, yeast plasmids, vectors derived from combinations of plasmids and phage DNA, and viral DNA such as vaccinia, adenovirus, fowl pox virus, and pseudorabies). It is contemplated that any vector may be used as long as it is replicable and viable in the host.

In particular, some embodiments of the present invention provide recombinant constructs comprising one or more of the sequences as broadly described above. In some embodiments of the present invention, the constructs comprise a vector, such as a plasmid or viral vector, into which a sequence of the invention has been inserted, in a forward or reverse orientation. In still other embodiments, the heterologous structural sequence is assembled in appropriate phase with translation initiation and termination sequences. In preferred embodiments of the present invention, the appropriate DNA sequence is inserted into the vector using any of a variety of procedures. In general, the DNA sequence is inserted into an appropriate restriction endonuclease site(s) by procedures known in the art.

Large numbers of suitable vectors are known to those of skill in the art, and are commercially available. Such vectors include, but are not limited to, the following vectors: 1) Bacterial—pQE70, pQE60, pQE-9 (Qiagen), pBS, pD10, phagescript, psiX174, pbluescript SK, pBSKS, pNH8A, pNH16a, pNH18A, pNH46A (Stratagene); ptrc99a, pKK223-3, pKK233-3, pDR540, pRIT5 (Pharmacia); 2) Eukaryotic—pWLNEO, pSV2CAT, pOG44, PXT1, pSG (Stratagene) pSVK3, pBPV, pMSG, pSVL (Pharmacia); and 3) Baculovirus—pPbac and pMbac (Stratagene). Any other plasmid or vector may be used as long as they are replicable and viable in the host. In some preferred embodiments of the present invention, mammalian expression vectors comprise an origin of replication, a suitable promoter and enhancer, and also any necessary ribosome binding sites, polyadenylation sites, splice donor and acceptor sites, transcriptional termination sequences, and 5' flanking non-transcribed sequences. In other embodiments, DNA sequences derived from the SV40 splice, and polyadenylation sites may be used to provide the required non-transcribed genetic elements.

In certain embodiments of the present invention, the DNA sequence in the expression vector is operatively linked to an appropriate expression control sequence(s) (promoter) to direct mRNA synthesis. Promoters useful in the present invention include, but are not limited to, the LTR or SV40 promoter, the E. coli lac or trp, the phage lambda PL and PR, T3 and T7 promoters, and the cytomegalovirus (CMV) immediate early, herpes simplex virus (HSV) thymidine kinase, and mouse metallothionein-I promoters and other promoters known to control expression of genes in prokaryotic or eukaryotic cells or their viruses. In other embodiments of the present invention, recombinant expression vectors include origins of replication and selectable markers permitting transformation of the host cell (e.g., dihydrofolate reductase or neomycin resistance for eukaryotic cell culture, or tetracycline or ampicillin resistance in E. coli).

In some embodiments of the present invention, transcription of the DNA encoding the polypeptides of the present invention by higher eukaryotes is increased by inserting an enhancer sequence into the vector. Enhancers are cis-acting elements of DNA, usually about from 10 to 300 bp that act on a promoter to increase its transcription. Enhancers useful in the present invention include, but are not limited to, the SV40 enhancer on the late side of the replication origin bp 100 to 270, a cytomegalovirus early promoter enhancer, the polyoma enhancer on the late side of the replication origin, and adenovirus enhancers.

In other embodiments, the expression vector also contains a ribosome binding site for translation initiation and a transcription terminator. In still other embodiments of the present invention, the vector may also include appropriate sequences for amplifying expression.

In a further embodiment, the present invention provides host cells containing the above-described constructs. In some embodiments of the present invention, the host cell is a higher eukaryotic cell (e.g., a mammalian or insect cell). In other embodiments of the present invention, the host cell is a lower eukaryotic cell (e.g., a yeast cell). In still other embodiments of the present invention, the host cell can be a prokaryotic cell (e.g., a bacterial cell). Specific examples of host cells include, but are not limited to, *Escherichia coli, Salmonella typhimurium, Bacillus subtilis*, and various species within the genera *Pseudomonas, Streptomyces*, and *Staphylococcus*, as well as *Saccharomyces cerevisiae, Schizosaccharomyces pombe, Drosophila* S2 cells, *Spodoptera* Sf9 cells, Chinese hamster ovary (CHO) cells, COS-7 lines of monkey kidney fibroblasts, (Gluzman, Cell 23:175 [1981]), C127, 3T3, 293, 293T, HeLa and BHK cell lines.

The constructs in host cells can be used in a conventional manner to produce the gene product encoded by the recombinant sequence. In some embodiments, introduction of the construct into the host cell can be accomplished by calcium phosphate transfection, DEAE-Dextran mediated transfection, or electroporation (See e.g., Davis et al., Basic Methods in Molecular Biology, [1986]). Alternatively, in some embodiments of the present invention, the polypeptides of the invention can be synthetically produced by conventional peptide synthesizers.

Proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al., Molecular Cloning: A Laboratory Manual, Second Edition, Cold Spring Harbor, N.Y., [1989].

In some embodiments of the present invention, following transformation of a suitable host strain and growth of the host strain to an appropriate cell density, the selected promoter is induced by appropriate means (e.g., temperature shift or chemical induction) and cells are cultured for an additional period. In other embodiments of the present invention, cells are typically harvested by centrifugation, disrupted by physical or chemical means, and the resulting crude extract retained for further purification. In still other embodiments of the present invention, microbial cells employed in expression of proteins can be disrupted by any convenient method, including freeze-thaw cycling, sonication, mechanical disruption, or use of cell lysing agents.

In preferred embodiments, the present invention provides a cell line (e.g., heterologous 293T cell line) comprising expression of a synthetic odorant receptor localized to the cell surface. In some embodiments, the odorant receptor is tagged with a reporting agent (e.g., glutathione-S-transferase (GST), c-myc, 6-histidine (6x-His), green fluorescent protein (GFP), maltose binding protein (MBP), influenza A virus haemagglutinin (HA), b-galactosidase, and GAL4).

The cell line described in this embodiment is not limited to particular odorant receptor families. In some embodiments, the odorant receptor family related to the synthetic odorant receptor is a human odorant receptor family or a murine odorant receptor family. In some embodiments, the odorant receptor family is a human odorant receptor family selected from human OR family 1, human OR family 2, human OR family 3, human OR family 4, human OR family 5, human OR family 6, human OR family 7, human OR family 8, human OR family 9, human OR family 10, human OR family 11, human OR family 12, human OR family 13, human OR family 14, human OR family 51, human OR family 52, human OR family 55, and human OR family 56. In some embodiments, the odorant receptor is a murine OR family selected from murine OR family 1, murine OR family 2, murine OR family 3, murine OR family 4, murine OR family 5, murine OR family 6, murine OR family 7, murine OR family 8, murine OR family 9, murine OR family 10-15, and murine OR family 16-34. In some embodiments, the odorant receptor family is mammalian odorant receptor family. In preferred embodiments, cell lines expressing odorant receptors are used in the classification of an odorant receptor's functional expression (e.g., ligand specificity). In even further embodiments, cell lines expressing odorant receptors are used in the classification of an animal's olfactory sensation.

The present invention also provides methods for recovering and purifying synthetic odorant receptor polypeptides from recombinant cell cultures including, but not limited to, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. In other embodiments of the present invention, protein-refolding steps can be used as necessary, in completing configuration of the mature protein. In still other embodiments of the present invention, high performance liquid chromatography (HPLC) can be employed for final purification steps.

The present invention further provides polynucleotides having a coding sequence of a synthetic odorant receptor gene fused in frame to a marker sequence that allows for purification of the polypeptide of the present invention. A non-limiting example of a marker sequence is a hexahistidine tag which may be supplied by a vector, preferably a pQE-9 vector, which provides for purification of the polypeptide fused to the marker in the case of a bacterial host, or, for example, the marker sequence may be a hemagglutinin (HA) tag when a mammalian host (e.g., COS-7 cells) is used. The HA tag corresponds to an epitope derived from the influenza hemagglutinin protein (Wilson et al., Cell, 37:767 [1984]).

In addition, the present invention provides fragments of synthetic odorant receptor polypeptides (i.e., truncation mutants). In some embodiments of the present invention, when expression of a portion of the synthetic odorant receptor protein is desired, it may be necessary to add a start codon (ATG) to the oligonucleotide fragment containing the desired sequence to be expressed. It is well known in the art that a methionine at the N-terminal position can be enzymatically cleaved by the use of the enzyme methionine aminopeptidase (MAP). MAP has been cloned from E. coli (Ben-Bassat et al., J. Bacteriol., 169:751 [1987]) and Salmonella typhimurium and its in vitro activity has been demonstrated on recombinant proteins (Miller et al., Proc. Natl. Acad. Sci. USA 84:2718 [1990]). Therefore, removal of an N-terminal methionine, if desired, can be achieved either in vivo by expressing such recombinant polypeptides in a host which produces MAP (e.g., E. coli or CM89 or S. cerevisiae), or in vitro by use of purified MAP.

The present invention also provides fusion proteins incorporating all or part of the synthetic odorant receptor polypeptides of the present invention. Accordingly, in some embodiments of the present invention, the coding sequences for the polypeptide can be incorporated as a part of a fusion gene including a nucleotide sequence encoding a different polypeptide. It is contemplated that this type of expression system will find use under conditions where it is desirable to produce an immunogenic fragment of a synthetic odorant receptor protein. In some embodiments of the present invention, the VP6 capsid protein of rotavirus is used as an immunologic carrier protein for portions of a synthetic odorant receptor polypeptide, either in the monomeric form or in the form of a viral particle. In other embodiments of the present invention, the nucleic acid sequences corresponding to the portion of a synthetic odorant receptor polypeptide against which antibodies are to be raised can be incorporated into a fusion gene construct which includes coding sequences for a late vaccinia virus structural protein to produce a set of recombinant viruses expressing fusion proteins comprising a portion of a synthetic odorant receptor as part of the virion. It has been demonstrated with the use of immunogenic fusion proteins utilizing the hepatitis B surface antigen fusion proteins that recombinant hepatitis B virions can be utilized in this role as well. Similarly, in other embodiments of the present invention, chimeric constructs coding for fusion proteins containing a portion of a synthetic odorant receptor polypeptide and the poliovirus capsid protein are created to enhance immunogenicity of the set of polypeptide antigens (See e.g., EP Publication No. 025949; and Evans et al., Nature 339:385 [1989]; Huang et al., J. Virol., 62:3855 [1988]; and Schlienger et al., J. Virol., 66:2 [1992]).

In still other embodiments of the present invention, the multiple antigen peptide system for peptide-based immunization can be utilized. In this system, a desired portion of a synthetic odorant receptor is obtained directly from organochemical synthesis of the peptide onto an oligomeric branching lysine core (see e.g., Posnett et al., J. Biol. Chem., 263:1719 [1988]; and Nardelli et al., J. Immunol., 148:914 [1992]). In other embodiments of the present invention, antigenic determinants of the synthetic odorant receptor proteins can also be expressed and presented by bacterial cells.

In addition to utilizing fusion proteins to enhance immunogenicity, it is widely appreciated that fusion proteins can also facilitate the expression of proteins, such as a synthetic odorant receptor protein of the present invention. Accordingly, in some embodiments of the present invention, synthetic odorant receptor polypeptides can be generated as glutathione-S-transferase (i.e., GST fusion proteins). It is contemplated that such GST fusion proteins will enable easy purification of synthetic odorant receptor polypeptides, such as by the use of glutathione-derivatized matrices (See e.g., Ausabel et al. (eds.), Current Protocols in Molecular Biology, John Wiley & Sons, NY [1991]). In another embodiment of the present invention, a fusion gene coding for a purification leader sequence, such as a poly-(His)/enterokinase cleavage site sequence at the N-terminus of the desired portion of a synthetic odorant receptor polypeptide, can allow purification of the expressed synthetic odorant receptor fusion protein by affinity chromatography using a $Ni^{2+}$ metal resin. In still another embodiment of the present invention, the purification leader sequence can then be subsequently removed by treatment with enterokinase (See e.g., Hochuli et al., J. Chromatogr., 411:177 [1987]; and Janknecht et al., Proc. Natl. Acad. Sci. USA 88:8972).

Techniques for making fusion genes are well known. Essentially, the joining of various DNA fragments coding for different polypeptide sequences is performed in accordance with conventional techniques, employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment of the present invention, the fusion gene can be synthesized by conventional techniques including automated DNA synthesizers. Alternatively, in other embodiments of the present invention, PCR amplification of gene fragments can be carried out using anchor primers which give rise to complementary overhangs between two consecutive gene fragments which can subsequently be annealed to generate a chimeric gene sequence.

Still other embodiments of the present invention provide mutant or variant forms of synthetic odorant receptor polypeptides (i.e., muteins). It is possible to modify the structure of a peptide having an activity of a synthetic odorant receptor polypeptide of the present invention for such purposes as enhancing therapeutic or prophylactic efficacy, disabling the protein, or stability (e.g., ex vivo shelf life, and/or resistance to proteolytic degradation in vivo). Such modified peptides are considered functional equivalents of peptides having an activity of the subject synthetic odorant receptor proteins as defined herein. A modified peptide can be produced in which the amino acid sequence has been altered, such as by amino acid substitution, deletion, or addition.

Moreover, as described above, variant forms (e.g., mutants or polymorphic sequences) of the subject synthetic odorant receptor proteins are also contemplated as being equivalent to those peptides and DNA molecules that are set forth in more detail. For example, as described above, the present invention encompasses mutant and variant proteins that contain conservative or non-conservative amino acid substitutions.

This invention further contemplates a method of generating sets of combinatorial mutants of the present synthetic odorant receptor proteins, as well as truncation mutants, and is especially useful for identifying potential variant sequences (i.e., mutants or polymorphic sequences) that are involved in neurological disorders (e.g., olfactory disorders) or resistance to neurological disorders. The purpose of screening such combinatorial libraries is to generate, for example, novel synthetic odorant receptor variants that can act as either agonists or antagonists, or alternatively, possess novel activities all together.

Therefore, in some embodiments of the present invention, synthetic odorant receptor variants are engineered by the present method to provide altered (e.g., increased or decreased) biological activity.

In some embodiments of the combinatorial mutagenesis approach of the present invention, the amino acid sequences for a population of synthetic odorant receptor homologs, variants or other related proteins are aligned, preferably to promote the highest homology possible. Such a population of variants can include, for example, synthetic odorant receptor homologs from one or more species, or synthetic odorant receptor variants from the same species but which differ due to mutation or polymorphisms. Amino acids that appear at each position of the aligned sequences are selected to create a degenerate set of combinatorial sequences.

In a preferred embodiment of the present invention, the combinatorial synthetic odorant receptor library is produced by way of a degenerate library of genes encoding a library of polypeptides which each include at least a portion of potential synthetic odorant receptor protein sequences. For example, a mixture of synthetic oligonucleotides can be enzymatically ligated into gene sequences such that the degenerate set of potential synthetic odorant receptor sequences are expressible as individual polypeptides, or alternatively, as a set of larger fusion proteins (e.g., for phage display) containing the set of synthetic odorant receptor sequences therein.

There are many ways by which the library of potential synthetic odorant receptor homologs and variants can be generated from a degenerate oligonucleotide sequence. In some embodiments, chemical synthesis of a degenerate gene sequence is carried out in an automatic DNA synthesizer, and the synthetic genes are ligated into an appropriate gene for expression. The purpose of a degenerate set of genes is to provide, in one mixture, all of the sequences encoding the desired set of potential synthetic odorant receptor sequences. The synthesis of degenerate oligonucleotides is well known in the art (See e.g., Narang, Tetrahedron Lett., 39:39 [1983]; Itakura et al., Recombinant DNA, in Walton (ed.), *Proceedings of the 3rd Cleveland Symposium on Macromolecules*, Elsevier, Amsterdam, pp 273-289 [1981]; Itakura et al., Annu. Rev. Biochem., 53:323 [1984]; Itakura et al., Science 198:1056 [1984]; Ike et al., Nucl. Acid Res., 11:477 [1983]). Such techniques have been employed in the directed evolution of other proteins (See e.g., Scott et al., Science 249:386 [1980]; Roberts et al., Proc. Natl. Acad. Sci. USA 89:2429 [1992]; Devlin et al., Science 249: 404 [1990]; Cwirla et al., Proc. Natl. Acad. Sci. USA 87: 6378 [1990]; each of which is herein incorporated by reference; as well as U.S. Pat. Nos. 5,223,409, 5,198,346, and 5,096,815; each of which is incorporated herein by reference).

It is contemplated that the synthetic odorant receptor nucleic acids of the present invention can be utilized as starting nucleic acids for directed evolution. These techniques can be utilized to develop synthetic odorant receptor variants having desirable properties such as increased or decreased biological activity.

In some embodiments, artificial evolution is performed by random mutagenesis (e.g., by utilizing error-prone PCR to introduce random mutations into a given coding sequence). This method requires that the frequency of mutation be finely tuned. As a general rule, beneficial mutations are rare, while deleterious mutations are common. This is because the combination of a deleterious mutation and a beneficial mutation often results in an inactive enzyme. The ideal number of base substitutions for targeted gene is usually between 1.5 and 5 (Moore and Arnold, Nat. Biotech., 14, 458 [1996]; Leung et al., Technique, 1:11 [1989]; Eckert and Kunkel, PCR Methods Appl., 1:17-24 [1991]; Caldwell and Joyce, PCR Methods Appl., 2:28 [1992]; and Zhao and Arnold, Nuc. Acids. Res., 25:1307 [1997]). After mutagenesis, the resulting clones are selected for desirable activity (e.g., screened for synthetic odorant receptor activity). Successive rounds of mutagenesis and selection are often necessary to develop enzymes with desirable properties. It should be noted that only the useful mutations are carried over to the next round of mutagenesis.

In an alternate embodiment of the invention, the coding sequence of a synthetic odorant receptor is synthesized, whole or in part, using chemical methods well known in the art (See e.g., Caruthers et al., Nucl. Acids Res. Symp. Ser., 7:215 [1980]; Crea and Horn, Nucl. Acids Res., 9:2331 [1980]; Matteucci and Caruthers, Tetrahedron Lett., 21:719 [1980]; and Chow and Kempe, Nucl. Acids Res., 9:2807 [1981]). In other embodiments of the present invention, the protein itself is produced using chemical methods to synthesize either an entire synthetic odorant receptor amino acid sequence or a portion thereof. For example, peptides can be synthesized by solid phase techniques, cleaved from the resin, and purified by preparative high performance liquid chromatography (See e.g., Creighton, *Proteins Structures And Molecular Principles*, W H Freeman and Co, New York N.Y. [1983]). In other embodiments of the present invention, the composition of the synthetic peptides is confirmed by amino acid analysis or sequencing (See e.g., Creighton, supra).

Direct peptide synthesis can be performed using various solid-phase techniques (Roberge et al., Science 269:202 [1995]) and automated synthesis may be achieved, for example, using ABI 431A Peptide Synthesizer (Perkin Elmer) in accordance with the instructions provided by the manufacturer. Additionally, the amino acid sequence of a synthetic odorant receptor polypeptide, or any part thereof, may be altered during direct synthesis and/or combined using chemical methods with other sequences to produce a variant polypeptide.

In some embodiments, the isolated nucleic acid and polypeptides of synthetic odorant receptor genes of the present invention and related proteins and nucleic acids are used in drug screening applications for compounds that alter (e.g., enhance or inhibit) synthetic odorant receptor activity and signaling. The present invention further provides methods of identifying ligands and signaling pathways of the synthetic odorant receptor proteins of the present invention.

The present invention is not limited to a particular mechanism. Indeed, an understanding of the mechanism is not necessary to practice the present invention. Nonetheless, based upon OR expression analysis experiments conducted during the course of the present invention, it is contemplated that synthetic odorant receptor family proteins function in promoting odorant receptor cell surface localization and functional expression.

In some embodiments, the present invention provides methods of screening compounds for the ability to alter synthetic odorant receptor activity mediated by natural ligands (e.g., identified using the methods described above). Such compounds find use in the treatment of disease mediated by synthetic odorant receptor (e.g., olfactory disorders), the alteration of olfactory sensory responses, and the like.

In some embodiments, the present invention provides methods of screening compounds for an ability to interact with mutant synthetic odorant receptor nucleic acid and/or mutant synthetic odorant receptor polypeptides. Such compounds find use in the treatment of olfactory disorders facilitated by the presence of mutant forms of synthetic odorant receptor nucleic acids and/or proteins.

The present invention contemplates the use of cell lines transfected with synthetic odorant receptor genes and variants thereof for screening compounds for activity, and in particular to high throughput screening of compounds from combinatorial libraries (e.g., libraries containing greater than $10^4$ compounds). The cell lines of the present invention can be used in a variety of screening methods. In some embodiments, the cells can be used in second messenger assays that monitor signal transduction following activation of cell-surface receptors. In other embodiments, the cells can be used in reporter gene assays that monitor cellular responses at the transcription/translation level.

In second messenger assays, the host cells are preferably transfected as described above with vectors encoding synthetic odorant receptor or variants or mutants thereof. The host cells are then treated with a compound or plurality of compounds (e.g., from a combinatorial library) and assayed for the presence or absence of a response. It is contemplated that at least some of the compounds in the combinatorial library can serve as agonists, antagonists, activators, or inhibitors of the protein or proteins encoded by the vectors or of ORs localized at the cell membrane. It is also contemplated that at least some of the compounds in the combinatorial library can serve as agonists, antagonists, activators, or inhibitors of protein acting upstream or downstream of the protein encoded by the vector in a signal transduction pathway.

In some embodiments, the second messenger assays measure fluorescent signals from reporter molecules that respond to intracellular changes (e.g., $Ca^{2+}$ concentration, membrane potential, pH, $IP_3$, cAMP, arachidonic acid release) due to stimulation of membrane receptors and ion channels (e.g., ligand gated ion channels; see Denyer et al., Drug Discov. Today 3:323 [1998]; and Gonzales et al., Drug. Discov. Today 4:431-39 [1999]). Examples of reporter molecules include, but are not limited to, FRET (florescence resonance energy transfer) systems (e.g., Cuo-lipids and oxonols, EDAN/DABCYL), calcium sensitive indicators (e.g., Fluo-3, FURA 2, INDO 1, and FLUO3/AM, BAPTA AM), chloride-sensitive indicators (e.g., SPQ, SPA), potassium-sensitive indicators (e.g., PBFI), sodium-sensitive indicators (e.g., SBFI), and pH sensitive indicators (e.g., BCECF).

In general, the host cells are loaded with the indicator prior to exposure to the compound. Responses of the host cells to treatment with the compounds can be detected by methods known in the art, including, but not limited to, fluorescence microscopy, confocal microscopy (e.g., FCS systems), flow cytometry, microfluidic devices, FLIPR systems (See, e.g., Schroeder and Neagle, J. Biomol. Screening 1:75 [1996]), and plate-reading systems. In some preferred embodiments, the response (e.g., increase in fluorescent intensity) caused by compound of unknown activity is compared to the response generated by a known agonist and expressed as a percentage of the maximal response of the known agonist. The maximum response caused by a known agonist is defined as a 100% response. Likewise, the maximal response recorded after addition of an agonist to a sample containing a known or test antagonist is detectably lower than the 100% response.

The cells are also useful in reporter gene assays. Reporter gene assays involve the use of host cells transfected with vectors encoding a nucleic acid comprising transcriptional control elements of a target gene (i.e., a gene that controls the biological expression and function of a disease target) spliced to a coding sequence for a reporter gene. Therefore, activation of the target gene results in activation of the reporter gene product.

The test compounds of the present invention can be obtained using any of the numerous approaches in combinatorial library methods known in the art, including biological libraries; peptoid libraries (libraries of molecules having the functionalities of peptides, but with a novel, non-peptide backbone, which are resistant to enzymatic degradation but which nevertheless remain bioactive; see, e.g., Zuckennann et al., J. Med. Chem. 37: 2678-85 [1994]); spatially addressable parallel solid phase or solution phase libraries; synthetic library methods requiring deconvolution; the 'one-bead one-compound' library method; and synthetic library methods using affinity chromatography selection. The biological library and peptide library approaches are preferred for use with peptide libraries, while the other four approaches are applicable to peptide, non-peptide oligomer or small molecule libraries of compounds (Lam (1997) Anticancer Drug Des. 12:145).

The ability of the test compound to modulate synthetic odorant receptor binding to a compound, e.g., an odorant receptor, can also be evaluated. This can be accomplished, for example, by coupling the compound, e.g., the substrate, with a radioisotope or enzymatic label such that binding of the compound, e.g., the substrate, to synthetic odorant receptor can be determined by detecting the labeled compound, e.g., substrate, in a complex.

The ability of a compound to interact with a synthetic odorant receptor with or without the labeling of any of the interactants can be evaluated. For example, a microphysiometer can be used to detect the interaction of a compound with synthetic odorant receptor without the labeling of the compound (McConnell et al. Science 257:1906-1912 [1992]). As used herein, a "microphysiometer" (e.g., Cytosensor) is an analytical instrument that measures the rate at which a cell acidifies its environment using a light-addressable potentiometric sensor (LAPS).

In yet another embodiment, a cell-free assay is provided in which synthetic odorant receptor protein or biologically active portion thereof is contacted with a test compound and the ability of the test compound to bind to the synthetic odorant receptor protein or biologically active portion thereof is evaluated. Preferred biologically active portions of synthetic odorant receptor proteins to be used in assays of the present invention include fragments that participate in interactions with substrates or other proteins, e.g., fragments with high surface probability scores.

Cell-free assays involve preparing a reaction mixture of the target gene protein and the test compound under conditions and for a time sufficient to allow the two components to interact and bind, thus forming a complex that can be removed and/or detected.

The interaction between two molecules can also be detected, e.g., using fluorescence energy transfer (FRET) (see, for example, Lakowicz et al., U.S. Pat. No. 5,631,169; Stavrianopoulos et al., U.S. Pat. No. 4,968,103; each of which is herein incorporated by reference). A fluorophore label is selected such that a first donor molecule's emitted fluorescent energy will be absorbed by a fluorescent label on a second, 'acceptor' molecule, which in turn is able to fluoresce due to the absorbed energy.

Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, the spatial relationship between the molecules can be assessed. In a situation in which binding occurs between the molecules, the fluorescent emission of the 'acceptor' molecule label in 1 5 the assay should be maximal. An FRET binding event can be conveniently measured through standard fluorometric detection means well known in the art (e.g., using a fluorimeter).

Modulators of synthetic odorant receptor expression can also be identified. For example, a cell or cell free mixture is contacted with a candidate compound and the expression of synthetic odorant receptor mRNA or protein evaluated relative to the level of expression of the synthetic odorant receptor mRNA or protein in the absence of the candidate compound. When expression of the synthetic odorant receptor mRNA or protein is greater in the presence of the candidate compound than in its absence, the candidate compound is identified as a stimulator of a synthetic odorant receptor mRNA or protein expression. Alternatively, when expression of synthetic odorant receptor mRNA or protein is less (i.e., statistically significantly less) in the presence of the candidate compound than in its absence, the candidate compound is identified as an inhibitor of synthetic odorant receptor mRNA or protein expression. The level of synthetic odorant receptor mRNA or protein expression can be determined by methods described herein for detecting synthetic odorant receptor mRNA or protein.

The present invention further provides pharmaceutical compositions which may comprise all or portions of synthetic odorant receptor polynucleotide sequences, synthetic odorant receptor polypeptides, inhibitors or antagonists of synthetic odorant receptor bioactivity, including antibodies, alone or in combination with at least one other agent, such as a stabilizing compound, and may be administered in any sterile, biocompatible pharmaceutical carrier, including, but not limited to, saline, buffered saline, dextrose, and water.

The methods of the present invention find use in treating diseases or altering physiological states characterized by mutant synthetic odorant receptor alleles. Peptides can be administered to the patient intravenously in a pharmaceutically acceptable carrier such as physiological saline. Standard methods for intracellular delivery of peptides can be used (e.g., delivery via liposome). Such methods are well known to those of ordinary skill in the art. The formulations of this invention are useful for parenteral administration, such as intravenous, subcutaneous, intramuscular, and intraperitoneal. Therapeutic administration of a polypeptide intracellularly can also be accomplished using gene therapy as described above.

As is well known in the medical arts, dosages for any one patient depends upon many factors, including the patient's size, body surface area, age, the particular compound to be administered, sex, time and route of administration, general health, and interaction with other drugs being concurrently administered.

Accordingly, in some embodiments of the present invention, synthetic odorant receptor nucleotide and synthetic odorant receptor amino acid sequences can be administered to a patient alone, or in combination with other nucleotide sequences, drugs or hormones or in pharmaceutical compositions where it is mixed with excipient(s) or other pharmaceutically acceptable carriers. In one embodiment of the present invention, the pharmaceutically acceptable carrier is pharmaceutically inert. In another embodiment of the present invention, synthetic odorant receptor polynucleotide sequences or synthetic odorant receptor amino acid sequences may be administered alone to individuals subject to or suffering from a disease.

Depending on the condition being treated, these pharmaceutical compositions may be formulated and administered systemically or locally. Techniques for formulation and administration may be found in the latest edition of "Remington's Pharmaceutical Sciences" (Mack Publishing Co, Easton Pa.). Suitable routes may, for example, include oral or transmucosal administration; as well as parenteral delivery, including intramuscular, subcutaneous, intramedullary, intrathecal, intraventricular, intravenous, intraperitoneal, or intranasal administration.

For injection, the pharmaceutical compositions of the invention may be formulated in aqueous solutions, preferably in physiologically compatible buffers such as Hanks' solution, Ringer's solution, or physiologically buffered saline. For tissue or cellular administration, penetrants appropriate to the particular barrier to be permeated are used in the formulation. Such penetrants are generally known in the art.

In other embodiments, the pharmaceutical compositions of the present invention can be formulated using pharmaceutically acceptable carriers well known in the art in dosages suitable for oral administration. Such carriers enable the pharmaceutical compositions to be formulated as tablets, pills, capsules, liquids, gels, syrups, slurries, suspensions and the like, for oral or nasal ingestion by a patient to be treated.

Pharmaceutical compositions suitable for use in the present invention include compositions wherein the active ingredients are contained in an effective amount to achieve the intended purpose. For example, an effective amount of synthetic odorant receptor may be that amount that suppresses olfactory disorder related symptoms. Determination of effective amounts is well within the capability of those skilled in the art, especially in light of the disclosure provided herein.

In addition to the active ingredients these pharmaceutical compositions may contain suitable pharmaceutically acceptable carriers comprising excipients and auxiliaries that facilitate processing of the active compounds into preparations that can be used pharmaceutically. The preparations formulated for oral administration may be in the form of tablets, dragees, capsules, or solutions.

The pharmaceutical compositions of the present invention may be manufactured in a manner that is itself known (e.g., by means of conventional mixing, dissolving, granulating, dragee-making, levigating, emulsifying, encapsulating, entrapping or lyophilizing processes).

Pharmaceutical formulations for parenteral administration include aqueous solutions of the active compounds in water-soluble form. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Aqueous injection suspensions may contain substances that increase the viscosity of the suspension, such as sodium carboxymethyl cellulose, sorbitol, or dextran. Optionally, the suspension may also contain suitable stabilizers or agents that increase the solubility of the compounds to allow for the preparation of highly concentrated solutions.

Pharmaceutical preparations for oral use can be obtained by combining the active compounds with solid excipient, optionally grinding a resulting mixture, and processing the mixture of granules, after adding suitable auxiliaries, if desired, to obtain tablets or dragee cores. Suitable excipients are carbohydrate or protein fillers such as sugars, including lactose, sucrose, mannitol, or sorbitol; starch from corn, wheat, rice, potato, etc; cellulose such as methyl cellulose, hydroxypropylmethyl-cellulose, or sodium carboxymethyl-cellulose; and gums including arabic and tragacanth; and proteins such as gelatin and collagen. If desired, disintegrating or solubilizing agents may be added, such as the cross-linked polyvinyl pyrrolidone, agar, alginic acid or a salt thereof such as sodium alginate.

Dragee cores are provided with suitable coatings such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, (i.e., dosage).

Pharmaceutical preparations that can be used orally include push-fit capsules made of gelatin, as well as soft, sealed capsules made of gelatin and a coating such as glycerol or sorbitol. The push-fit capsules can contain the active ingredients mixed with a filler or binders such as lactose or starches, lubricants such as talc or magnesium stearate, and, optionally, stabilizers. In soft capsules, the active compounds may be dissolved or suspended in suitable liquids, such as fatty oils, liquid paraffin, or liquid polyethylene glycol with or without stabilizers.

Compositions comprising a compound of the invention formulated in a pharmaceutical acceptable carrier may be prepared, placed in an appropriate container, and labeled for treatment of an indicated condition. For polynucleotide or amino acid sequences of synthetic odorant receptor, conditions indicated on the label may include treatment of condition related to olfactory disorders.

The pharmaceutical composition may be provided as a salt and can be formed with many acids, including but not limited to hydrochloric, sulfuric, acetic, lactic, tartaric, malic, succinic, etc. Salts tend to be more soluble in aqueous or other protonic solvents that are the corresponding free base forms. In other cases, the preferred preparation may be a lyophilized powder in 1 mM-50 mM histidine, 0.1%-2% sucrose, 2%-7% mannitol at a pH range of 4.5 to 5.5 that is combined with buffer prior to use.

For any compound used in the method of the invention, the therapeutically effective dose can be estimated initially from cell culture assays. Then, preferably, dosage can be formulated in animal models (particularly murine models) to achieve a desirable circulating concentration range that adjusts synthetic odorant receptor levels.

A therapeutically effective dose refers to that amount of synthetic odorant receptor that ameliorates symptoms of the disease state. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index, and it can be expressed as the ratio $LD_{50}/ED_{50}$. Compounds that exhibit large therapeutic indices are preferred. The data obtained from these cell culture assays and additional animal studies can be used in formulating a range of dosage for human use. The dosage of such compounds lies preferably within a range of circulating concentrations that include the $ED_{50}$ with little or no toxicity. The dosage varies within this range depending upon the dosage form employed, sensitivity of the patient, and the route of administration.

The exact dosage is chosen by the individual physician in view of the patient to be treated. Dosage and administration are adjusted to provide sufficient levels of the active moiety or to maintain the desired effect. Additional factors which may be taken into account include the severity of the disease state; age, weight, and gender of the patient; diet, time and frequency of administration, drug combination(s), reaction sensitivities, and tolerance/response to therapy. Long acting pharmaceutical compositions might be administered every 3 to 4 days, every week, or once every two weeks depending on half-life and clearance rate of the particular formulation.

Normal dosage amounts may vary from 0.01 to 100,000 micrograms, up to a total dose of about 1 g, depending upon the route of administration. Guidance as to particular dosages and methods of delivery is provided in the literature (See, U.S. Pat. Nos. 4,657,760; 5,206,344; or 5,225,212, all of which are herein incorporated by reference). Those skilled in the art will employ different formulations for synthetic odorant receptor than for the inhibitors of synthetic odorant receptor. Administration to the bone marrow may necessitate delivery in a manner different from intravenous injections.

The present invention provides methods for identifying ligands specific for odorant receptors. The present invention is not limited to a particular method for indentifying ligands specific for odorant receptors. In preferred embodiments, the present invention provides a cell line (e.g., heterologous 293T cell line) expressing a synthetic odorant receptor localized to the cell surface. Activation of an odorant receptor results in an increase in cAMP. As such, in some embodiments, the cell line further comprises a cAMP responsive element linked with a reporting agent (e.g., luciferase) for detecting odorant receptor activation. An odiferous molecule (e.g., eugenol) is exposed to the cell line. If the odiferous molecule is a ligand specific for the odorant receptor, luciferase expression or a change in luciferase expression is detectable.

EXPERIMENTAL

Example I

This example demonstrates that a TM4 residue, G (4.53), is crucial for cell surface trafficking of model ORs.

Figure 1:
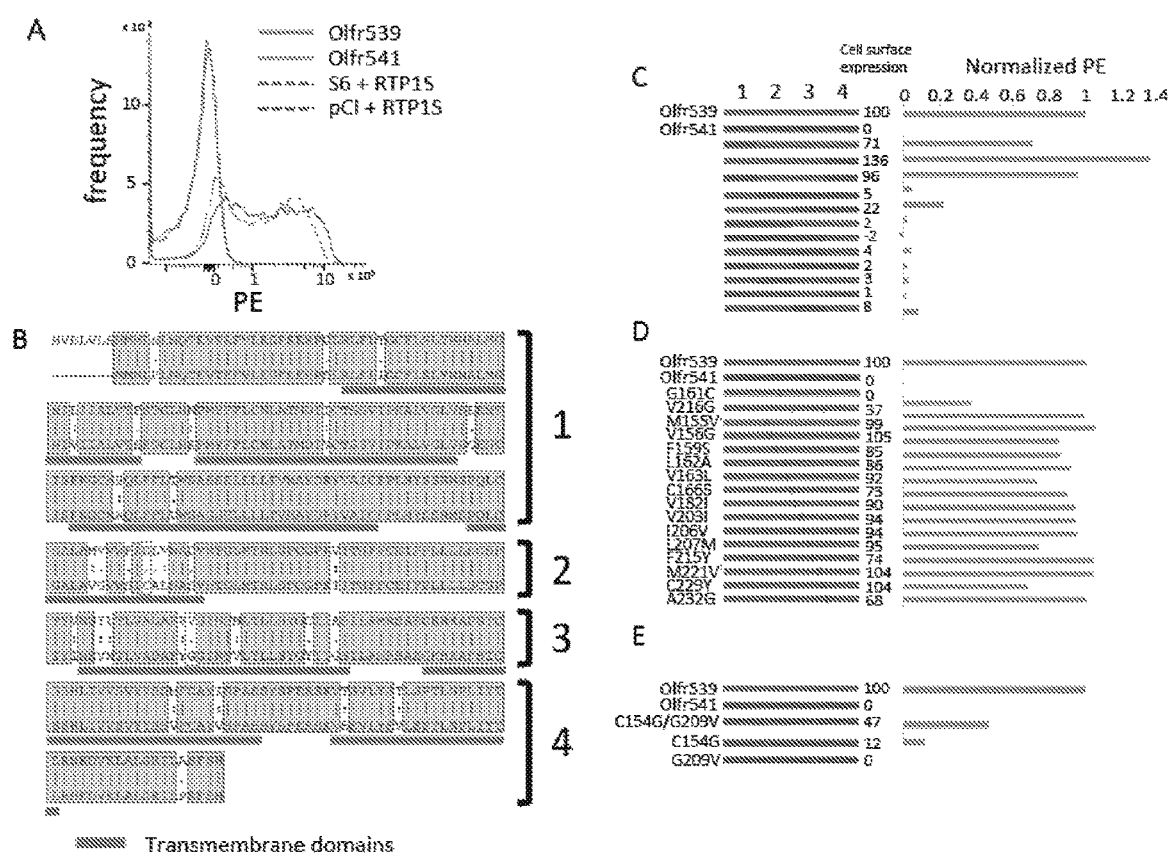
FIG. 1. G154 (4.53) and V209 (5.47) are critical to cell surface expression of Olfr539 and Olfr541 (A) Olfr539 robustly but Olfr541 poorly expresses in the cell surface in heterologous cells in the absence of RTP1 and RTP2. (B) Alignment of protein sequences of Olfr539 and Olfr541. 90% of the amino acid residues are shared between the model ORs. (C) Designs of chimeric ORs created by replacing parts of Olfr539 (red) with those of Olfr541 (blue) (left side) and FACS results of the chimeric ORs (right side). (D) Designs of single amino acid mutants created by substituting single amino acids of Olfr539 in region 2 and 3 for those of Olfr541 (left side) and FACS results of the mutant ORs (right side). (E) Designs of reciprocal Olfr541 mutants created by substituting single or double amino acids of Olfr541 with those of Olfr539 (left side) and FACS results of the mutant ORs (right side).

Experiments utilized Olfr539 and Olfr541 with 90% amino acid identity transiently expressed in 293T cells as a model system to study OR trafficking in non olfactory cells. Olfr539 is an oOR, an indication of function in the absence of RTP1 and RTP2 in vivo, and show robust cell surface expression in HEK293T cells. In contrast, Olfr541 is a uOR, an indication of requirement of RTP1 and RTP2 for its function in vivo, and show no detectable cell surface expression in HEK293T cells (FIG. 1a, 1b). Experiments generated a series of chimeric ORs by replacing a part of the amino acid sequence of Olfr539 with that of Olfr541 (FIG. 1c). Cell surface expression levels of the chimeric ORs were measured by FACS analyses. Mutant ORs which had the middle region (from $152^{th}$ residue to $247^{th}$ residue) of Olfr539 showed high surface expression levels, indicating an important domain for cell surface expression.

As the middle region contained 16 non-conserved amino acid residues between these ORs, single amino acid mutants of each residue of Olfr539 were next generated by substituting each non-conserved amino acid residue of Olfr539 with that of Olfr541 (FIG. 1d). FACS analysis showed that Olfr539 G161C (4.53 according to the Ballesteros-Weinstein notation) (see, Ballesteros, J. A. & Weinstein, H. Biophysical journal 62, 107-109 (1992)) abolished cell surface expression and V216G (5.47) diminished cell surface expression, indicating that these two residues are critical in determining cell surface expression levels. Other residues had no or little effects for cell surface expression. Accordingly, experiments next generated and expressed the reciprocal single mutants Olfr541 C154G (4.53) and Olfr541 G209V (5.47), and the double mutant Olfr541 C154G (4.53)/G209V (5.47) to test if these residues are sufficient for cell surface expression. Olfr541 C154G (4.53) shows moderate level of cell surface expression although Olfr541 G209V (5.47) does not show any improvements (FIG. 1e). Olfr541 C154G (4.53)/G209V (5.47) show enhanced cell surface expression than C154G (4.53) alone, suggesting a synergistic interaction between the two critical residues in facilitating cell surface trafficking.

Figure 2:
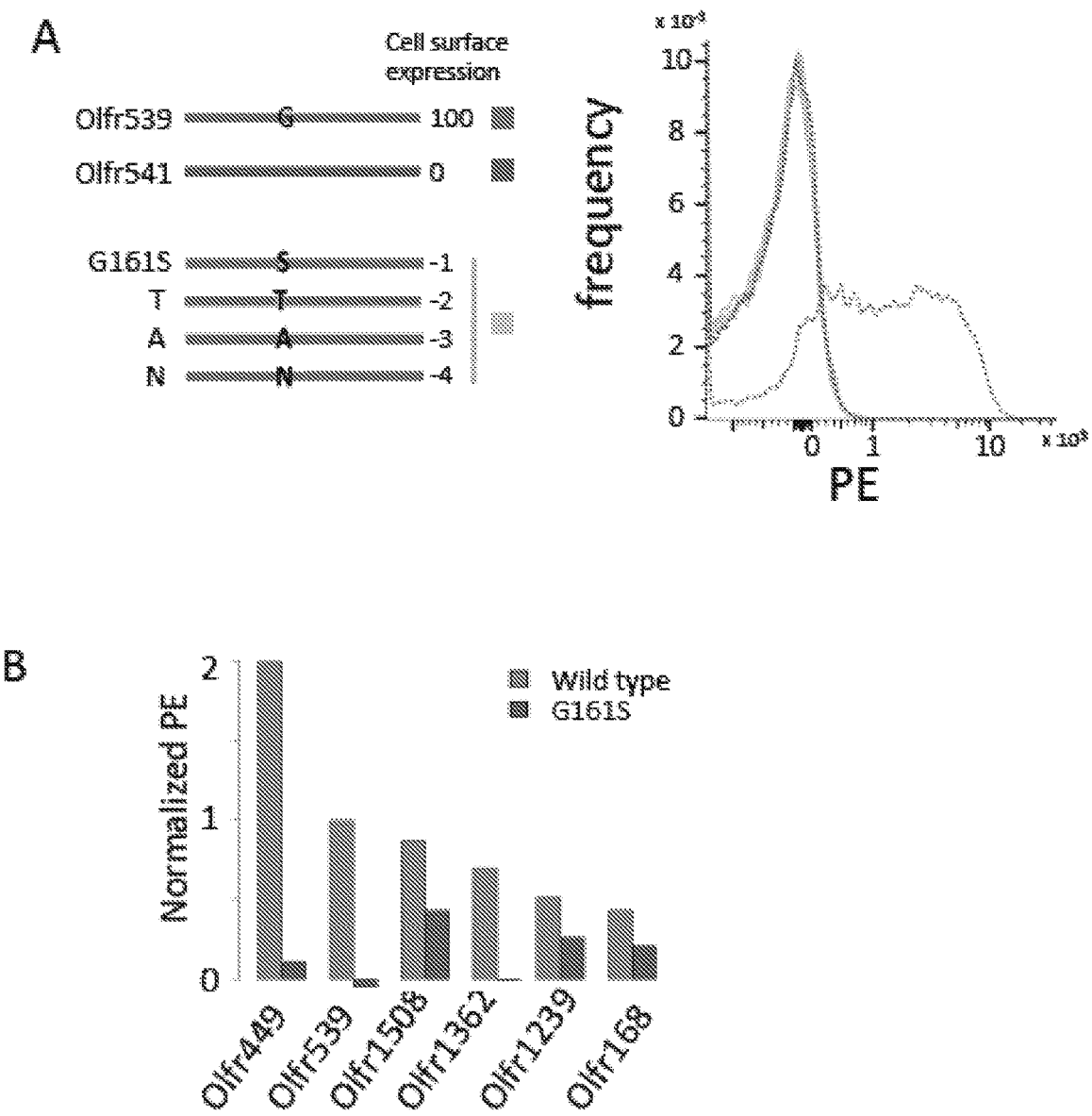
FIG. 2. Requirement of G (4.53) for cell surface expression of ORs in the absence of RTP1 and RTP2. (A) Olfr539 mutants created by substituting G154 (4.53) with S, T, A or N, which are conserved in more than 1% of ORs, lose cell surface expression. (B) G154S mutants of RTP-independent ORs (Olfr449, Olfr539, Olfr1508, Olfr1362, Olfr1239 and Olfr168) (blue) show less cell surface expression levels compared with the wild types (red) in the absence of RTP1 and RTP2.

Experiments further investigated which properties of G (4.53) were tied with controlling the cell surface trafficking, generating mutants by substituting G161 (4.53) of Olfr539 for other amino acids (S, T, A or N), which were present in more than 1% of mouse ORs. None of these mutants exhibited cell surface expression, indicating strict requirement of G residue at the position (4.53) for cell surface trafficking of Olfr539 (FIG. 2a).

Experiments next tested whether G (4.53) controlled the cell surface trafficking of other ORs that are trafficked to the surface. From a set of ORs that show robust cell surface expression in HEK293T cells (RTP-independent ORs, see below for details), five ORs were chosen (Olfr1362, Olfr1508, Olfr449, Olfr168 and Olfr1239) and changed the their G at (4.53) position into S and conducted FACS analyses. All the mutants showed abolished or diminished cell surface expression (FIG. 2b). This result further supports the importance of the G (4.53) residue in facilitating cell surface trafficking of ORs.

Example II

This example demonstrates a contribution of G (4.53) in structural stability.

Figure 3:
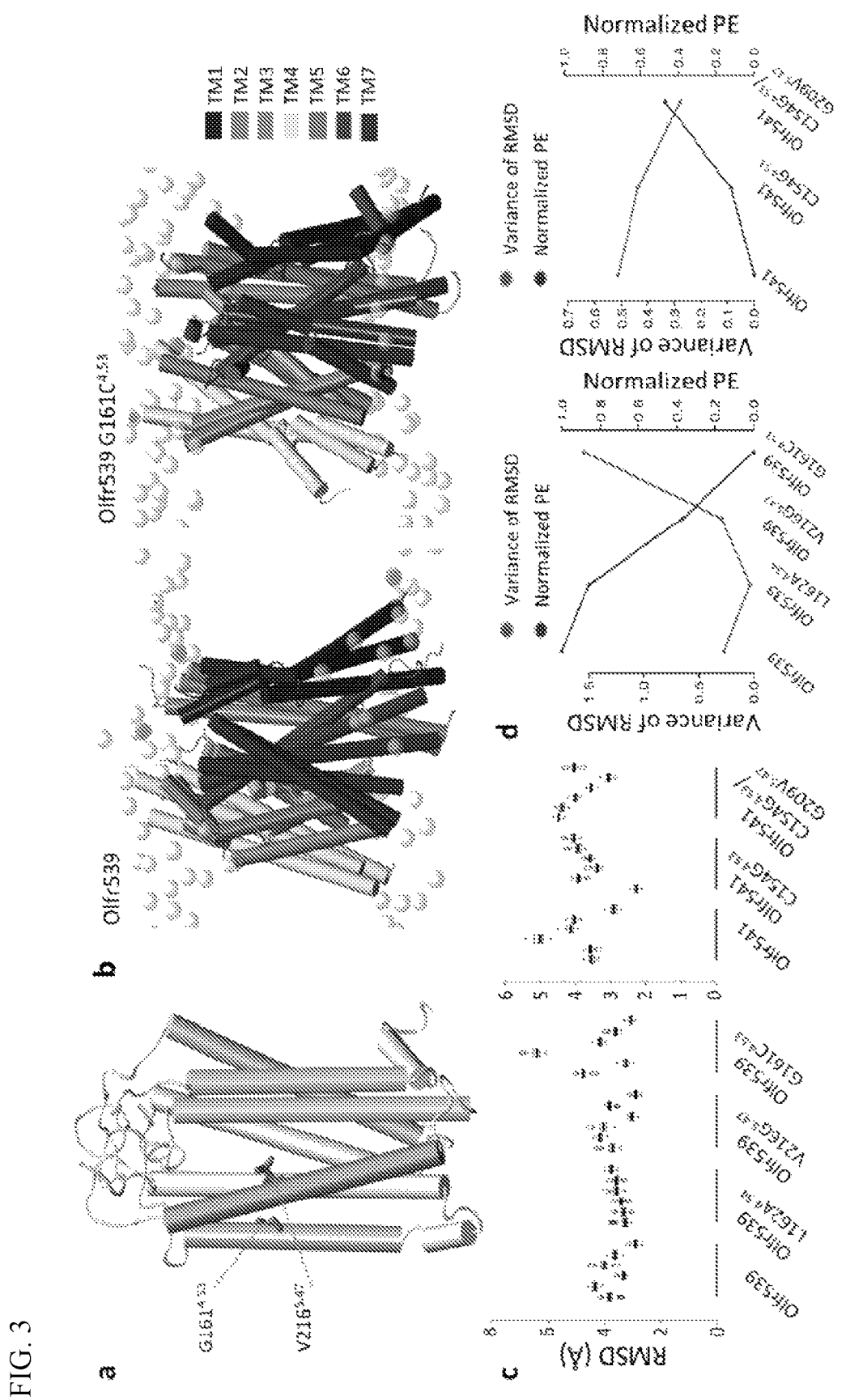
FIG. 3. (A) 3D homology model of Olfr539. TM4 and TM5 are represented in tubes and the remaining structure in ribbon. G154 (4.53) and V209 (5.47) are developed in licorice and colored pink. (B) Superposed images of triplication of wild type Olfr539 (left) and Olfr539 G154S (right) after 500ns molecular dynamics simulations in virtual plasma membrane. (C) RMSDs of 6 individual simulations of Olfr539 systems (wild type, L155A, G154C and V209G) (left), and Olfr541 systems (wild type, C154G and C154G/G209V). The models are placed in descending order based on cell surface expression levels for Olfr539 systems and in ascending order for Olfr541 systems. (D) Plots of variance of mean RMSDs (left axis, red plots) and cell surface expression levels (right axis, blue plots) of Olfr539 systems (left) and Olfr541 systems (right). Cell surface expression levels of G154S mutants of RTP-independent ORs (Olfr449, Olfr539,Olfr1508, Olfr1362, Olfr1239 and Olfr168) are increased by co-transfection with RTP1S except for Olfr1239.

In order to deduce how the two critical residues, G (4.53) and V (5.47), control the cell surface trafficking, experiments investigated locations of the amino acid residues in a 3D structure model of Olfr539 and Olfr541. The 3D structure model was constructed based on known GPCR structures, corresponding to the prototypic inactive state of GPCRs[15][16] G (4.53) and V (5.47) are in the middle of the $4^{th}$ and $5^{th}$ transmembrane domains (TM), respectively, and they face inward, suggesting that these amino acids are not likely to control cell surface trafficking through direct interactions with other proteins (FIG. 3a).

Figure 4:
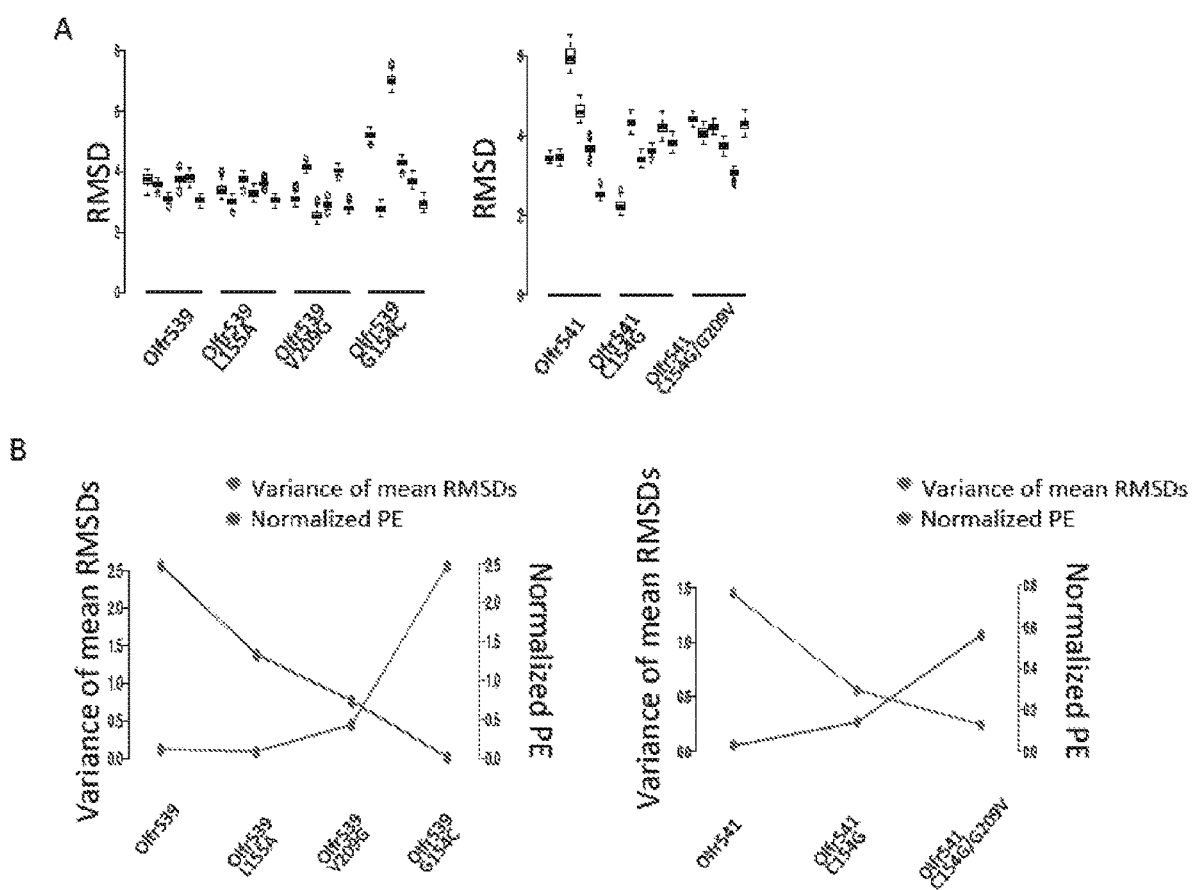
FIG. 4. Distribution of Grantham distances at the 45 sites. i-i, d-d and i-d indicate Grantham distances among RTP-independent ORs, among RTP-dependent ORs and between RTP-dependent ORs and RTP-dependent ORs respectively.

Experiments hypothesized that low levels of structural stability of ORs might cause ER retention by general quality control mechanisms and G (4.53) and V (5.47) are important for stabilization of the ORs. To start testing this possibility, 3D structural models of Olfr539 and Olfr541 were built, their mutants at the critical residues, namely Olfr539 G161C (4.53), Olfr539 V216G (5.47), Olfr541 C154G (4.53) and Olfr541 C154G (4.53)/G209V (5.47), as well as a control mutant Olfr539 L162A (4.54), and ran six independent molecular dynamic (MD) simulations of all the models. To compare the structural stability of each models, experiments compared the six structures of the same receptor equilibrated by 500 ns of molecular dynamic simulation. Olfr539 models appeared to show more similar structures through the replications than those of Olfr539 G161C (4.53) (FIG. 3b). To quantify structural similarities, experiments calculated root mean square deviation (RMSD) of atomic positions of TM domains for each MD simulation. Olfr539 and L162A (4.54), which are expressed on the cell surface in heterologous cells, showed similar RMSD among replications while G161C (4.53) and V216G (5.47), which are poorly expressed, showed varied RMSD, indicating poorly trafficked ORs have more flexible structure (FIG. 3c; FIG. 11). In contrast, Olfr541 showed a wide range of RMSD whereas its mutants C154G (4.53) and C154G/G209V showed similar RMSD (FIG. 3c). To examine whether structural stability is associated with cell surface expression level, surface expression levels and variances of RMSDs for both Olfr539 and Olfr541 system were plotted. Indeed the mutants with lower cell surface expression showed larger variance of RMSDs. Conversely the mutants with higher cell surface expression showed smaller variance of RMSDs (FIG. 3d). This trend is more pronounced in RMSDs calculated for the extracellular (EC) side of TM domains, suggesting stabilities of this part might be especially important for cell surface expression (FIG. 4). These data supports the hypothesis that structural stability contributes cell surface expression of ORs.

Example III

This example provides a comprehensive evaluation of cell surface expression levels of ORs in heterologous cells.

Figure 5:
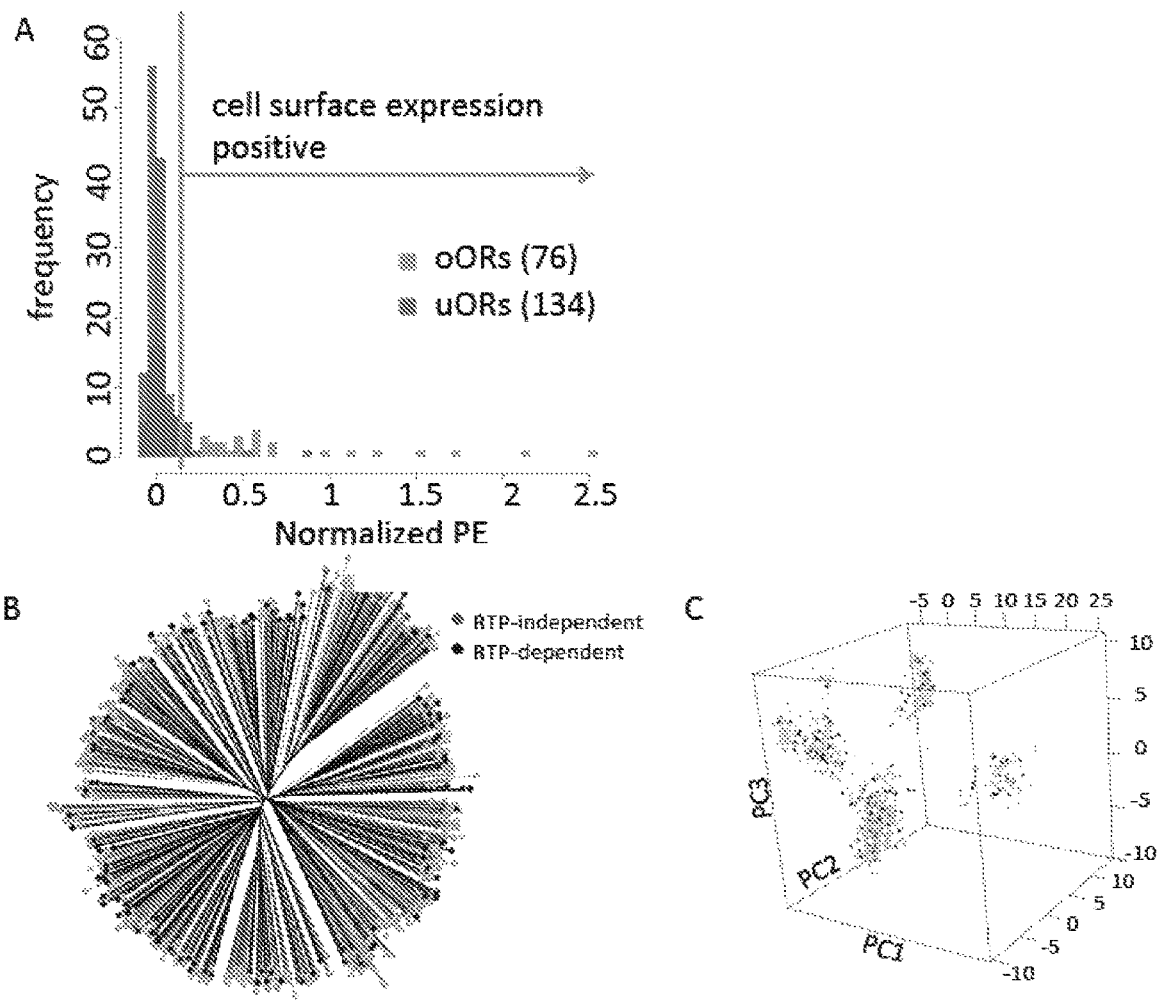
FIG. 5. FACS analyses for a large repertoire of moue ORs in heterologous cells in the absence of RTP1 and RTP2 (A) Histogram of cell surface expression levels of 76 oORs (red) and 134 uORs (blue). When experiments assumed that the distribution is superposition of normal distributions of cell surface expression positive ORs and negative ORs, 0.144 (vertical line) is the upper 0.1 percentile of the negative ORs. (B) Phylogenetic tree of protein sequences of mouse ORs. Red, black and gray indicate RTP-independent ORs, RTP-dependent ORs and the others, respectively. (C) Principle component analyses based classification of ORs. Shown is a plot of the first three principal components (variance explained: 6.9%, 3.6%, 2.7%). Red, black and gray indicate RTP-independent ORs, RTP-dependent ORs and the others, respectively.

Experiments conducted for the present invention showed that the TM4 residue (4.53) has crucial role in OR trafficking. However it is unlikely that (4.53) is the sole determinant, as G (4.53) is present in 66% of mouse ORs yet the vast majority of ORs do not show cell surface expression in heterologous cells. To gain more comprehensive understanding of OR cell surface expression, 210 ORs (76 oORs and 134 uORs) were selected and which ORs exhibit cell surface expression in heterologous cells tested. Each OR was transfected with an N-terminal Rho tag in HEK293T cells in the absence of RTP1 and RTP2, and performed a FACS to quantify surface OR levels in these cells. Consistent with previous finding (see, Sharma, R., et al. eLife 6 (2017)), oORs as a group showed more robust OR surface expression than uORs (p<0.05, U test) (FIG. 5a). Using an assumption that surface expression levels was the overlapping of two normal distributions of positive ORs and negative ORs, the ORs were defined with expression levels of more than 0.144 (A.U.) as positive ORs (cut off=top 0.001 of negative ORs). 34/210 ORs (14.0%) were positive under this criterion. Consistent with more robust cell surface expression of oORs, 26/76 (34.2%) of oORs, but only 8/134 (6.0%) of uORs, showed positive cell surface expression. Furthermore, top seven ORs with most robust surface expression are all oORs. The 26 ORs were defined, which are oORs and cell surface expression positive, as RTP-independent ORs and the 126 ORs, which are uORs and cell surface expression negative, as RTP-dependent ORs.

Example IV

This example demonstrated that scattered residues are associated with cell surface trafficking of ORs.

Figure 6:
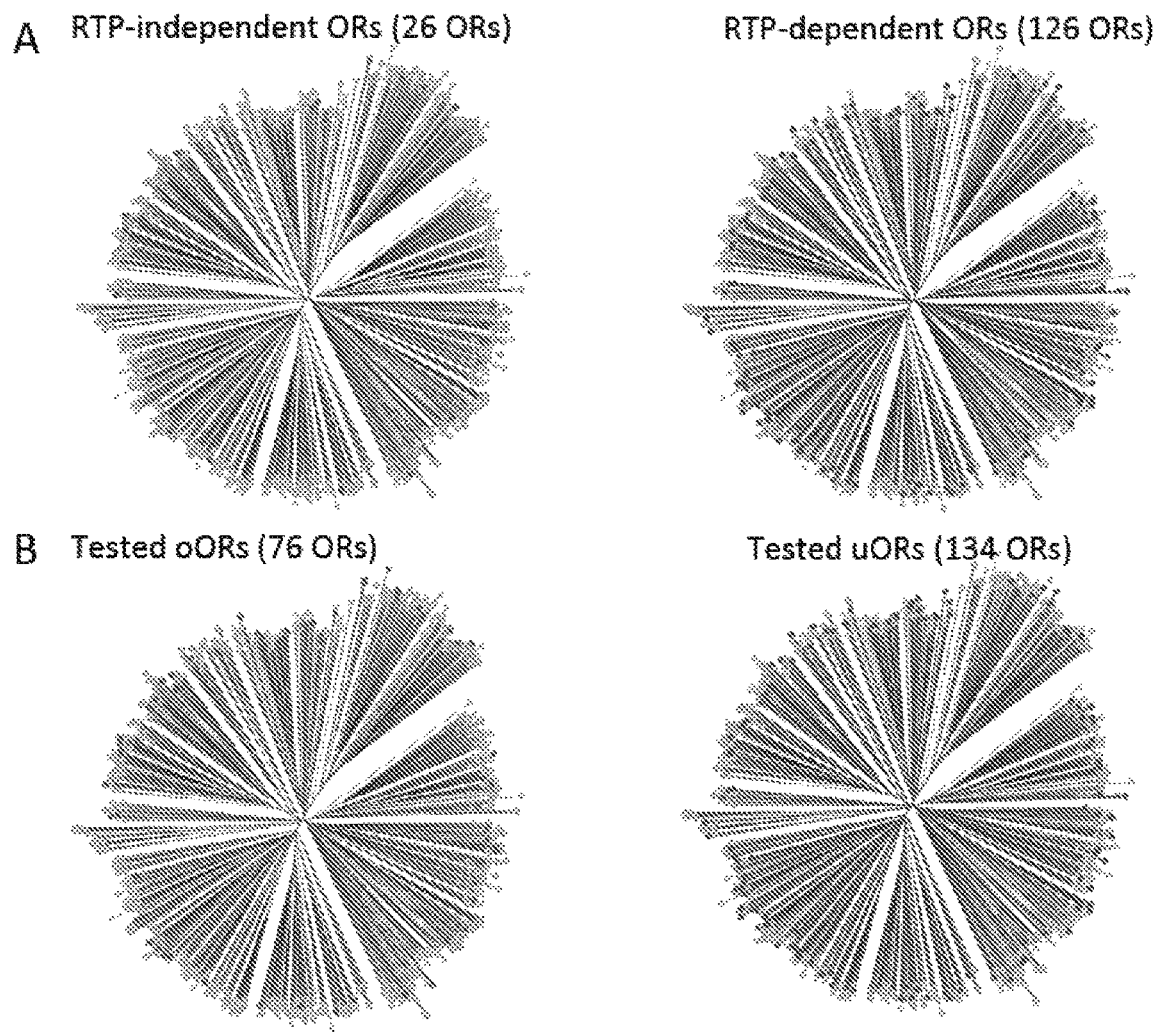
FIG. 6. The identified 45 sites adhere to highly conserved sites. The identified 45 sites are colored on protein sequences of ORs with amino acid conservation degree.

It was hypothesized that residues specific to RTP-independent or RTP-dependent ORs are critical for OR trafficking in the absence of RTP1 and RTP2. To start investigating whether overall amino acid sequence similarities are associated with cell surface trafficking, it was asked whether RTP-independent and/or RTP-dependent ORs are clustered in a phylogenetic tree. Both are distributed on multiple branches, indicating overall similarities do not determine their ability to be trafficked to the cell surface (FIG. 5b and FIG. 6). As a similar approach, it was also asked whether RTP-independent and/or RTP-dependent ORs are clustered on principal component analysis-based classification of OR amino acid sequences. A principal component analysis of amino acid properties of ORs identified four clusters and, both RTP-independent and dependent ORs are spread through all the clusters, again supporting overall amino acid similarities do not determine cell surface trafficking of ORs (FIG. 5c).

Next, it was hypothesized that amino acid residues at particular positions control cell surface trafficking. To investigate this idea 26 RTP independent and 126 RTP dependent ORs (total of 152 ORs) were aligned and Grantham distances of amino acid properties at individual sites calculated, identifying 66 sites with lower Grantham distances among RTP-independent ORs than among all the tested ORs ($p<0.05$, t test with Bonferroni correction). As expected, (4.53) is one of these 66 sites; 80.8% of RTP-independent ORs have G residue whereas only 61.1% of RTP-dependent ORs have G residue.

Figure 7A:
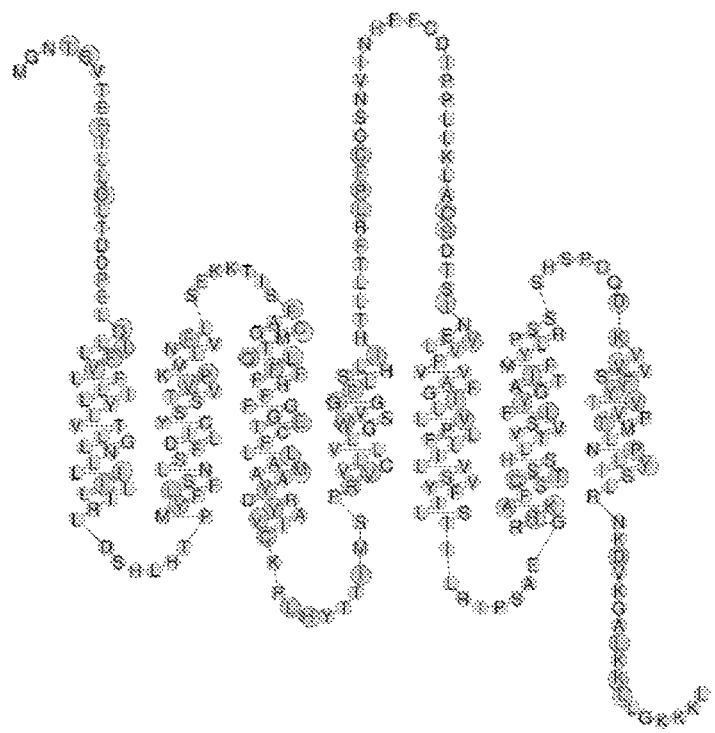
FIG. 7. Identifying amino acid residues involved in RTP dependence (A) Snake plot of the consensus protein sequence of ORs. The 66 sites with less diverse residues in RTP-independent ORs ($p<0.05$, Bonferroni test) are colored red. (B) RTP dependence of tested ORs is predicted using SVM-based classifiers based on amino acid properties in ten-fold cross-validation, and the accuracy is validated by the ROC curves. (C) Conservation degree of amino acid residues at the 66 sites. All ORs, RTP-independent ORs and RTP-dependent ORs show similar amino acid conservation. (D) Usage rate of consensus residues at the 66 sites. RTP-independent ORs more frequently use consensus residues than RTP-dependent ORs at 58 out of 66 sites.
Figure 7B:
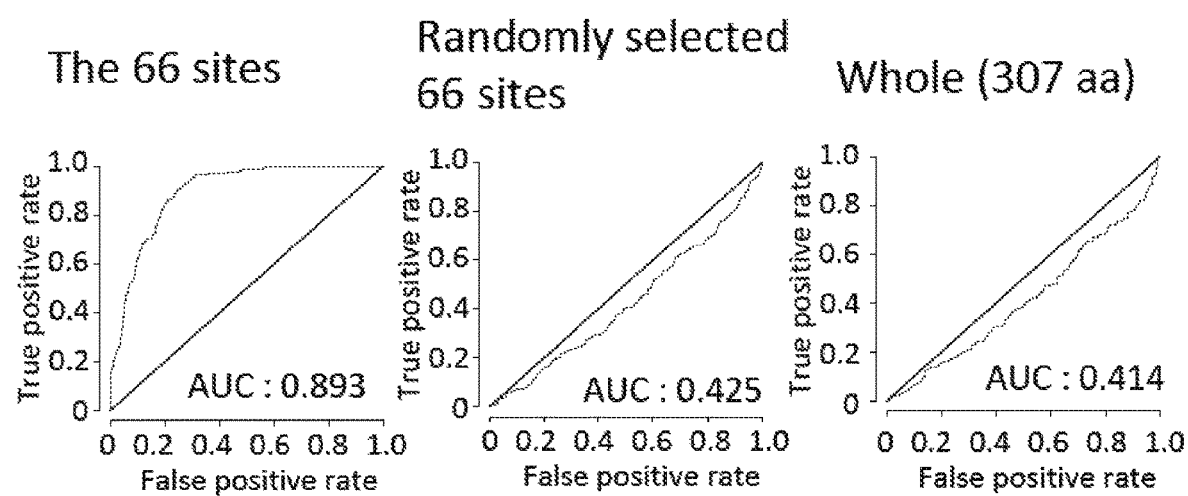
Figure 7C:
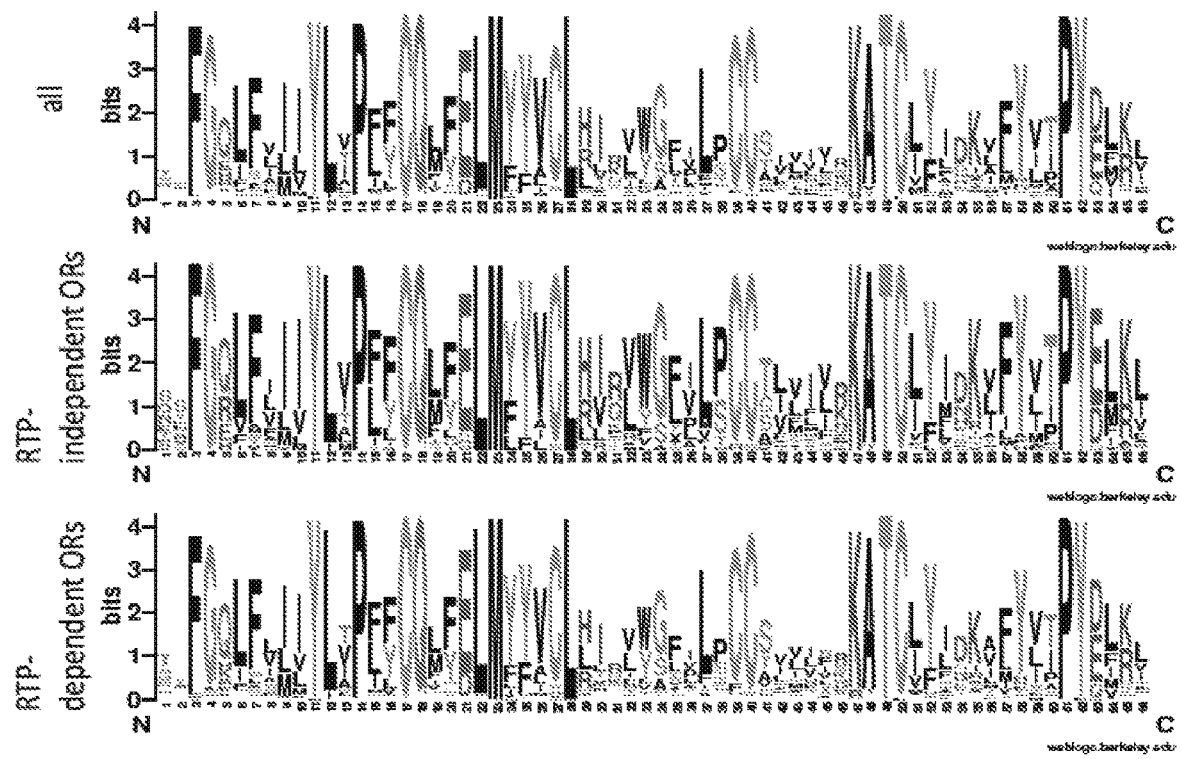
Figure 7D:
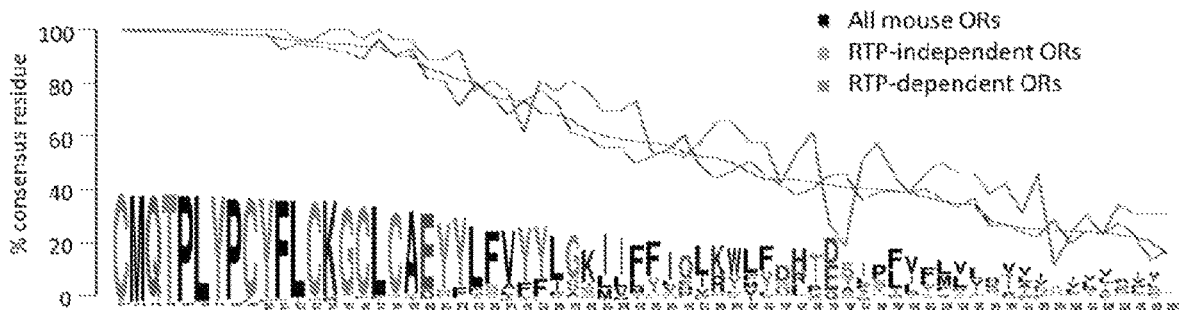

Contrary to the initial assumption of specific domains controlling OR cell surface expression, the 66 sites are scattered throughout the OR proteins including transmembrane, extracellular and intracellular domains. Moreover, there was no site that is exclusively present in one of the groups, suggesting there is no trafficking promotion or inhibition signals shared with all ORs (FIG. 7a). To investigate whether these 66 sites of amino acid residues can predict the RTP dependence of ORs, experiments classified tested ORs by support vector machine based classifiers in ten-fold cross-validation. The classifier, generated by the 66 sites of amino acid residues, robustly discriminated RTP-independent ORs ($p<0.05$, Wilcoxon test; AUC=0.893) but those generated by randomly selected 66 sites ($p=0.999$, Wilcoxon test; AUC=0.425) and all sites ($p=0.999$, Wilcoxon test; AUC=0.414) did not, suggesting these 66 sites predict whether an OR shows cell surface expression in heterologous cells (FIG. 6b).

Figure 8:
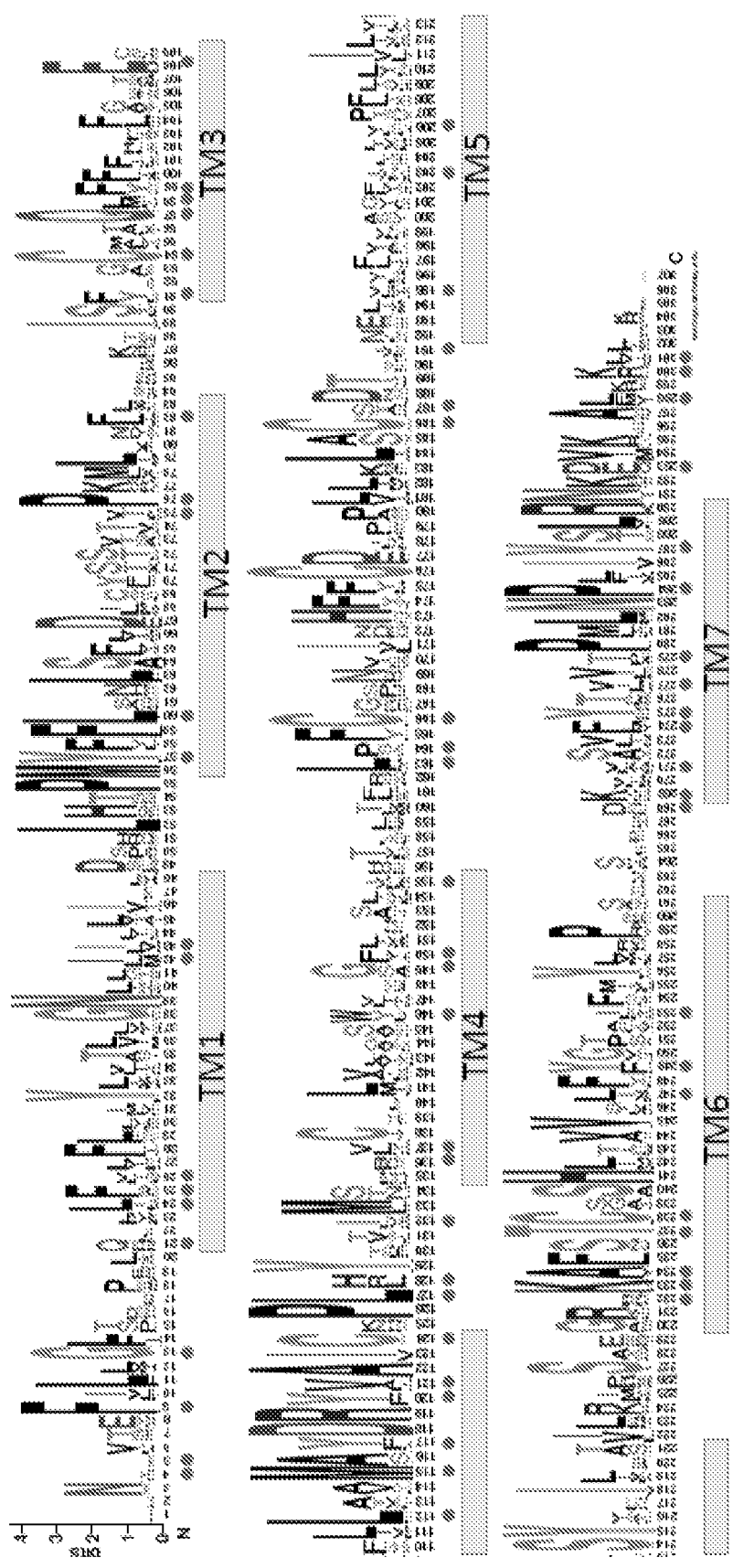
FIG. 8. (A, B) RMSDs of top half (cavity side) of transmembrane domains.

Experiments next questioned which properties in these 66 residues are associated with cell surface expression. When conservation degree of these amino acid residues was examined, many of these sites were conserved among ORs (FIG. 6c; FIG. 8). 29% of the sites (19/66) are conserved more than 90% of ORs whereas 13% of the sites (41/307) are conserved more than 90% of full length OR ($p=0.0048$, Fisher's exact test). Experiments plotted frequency of most common amino acid resides at individual sites for RTP-independent and RTP-dependent ORs, indicating RTP-independent ORs used consensus amino acid residues much more frequently than RTP-dependent ORs (58 sites out of the 66 sites, $p=6.35\times10^{-6}$, chi-square test), suggesting ORs that are in line with consensus amino acids in these positions are more likely to show cell surface expression (FIG. 6d).

Example V

This example demonstrates that synthetic consensus ORs are robustly expressed in the cell surface in heterologous cells.

Figure 9:
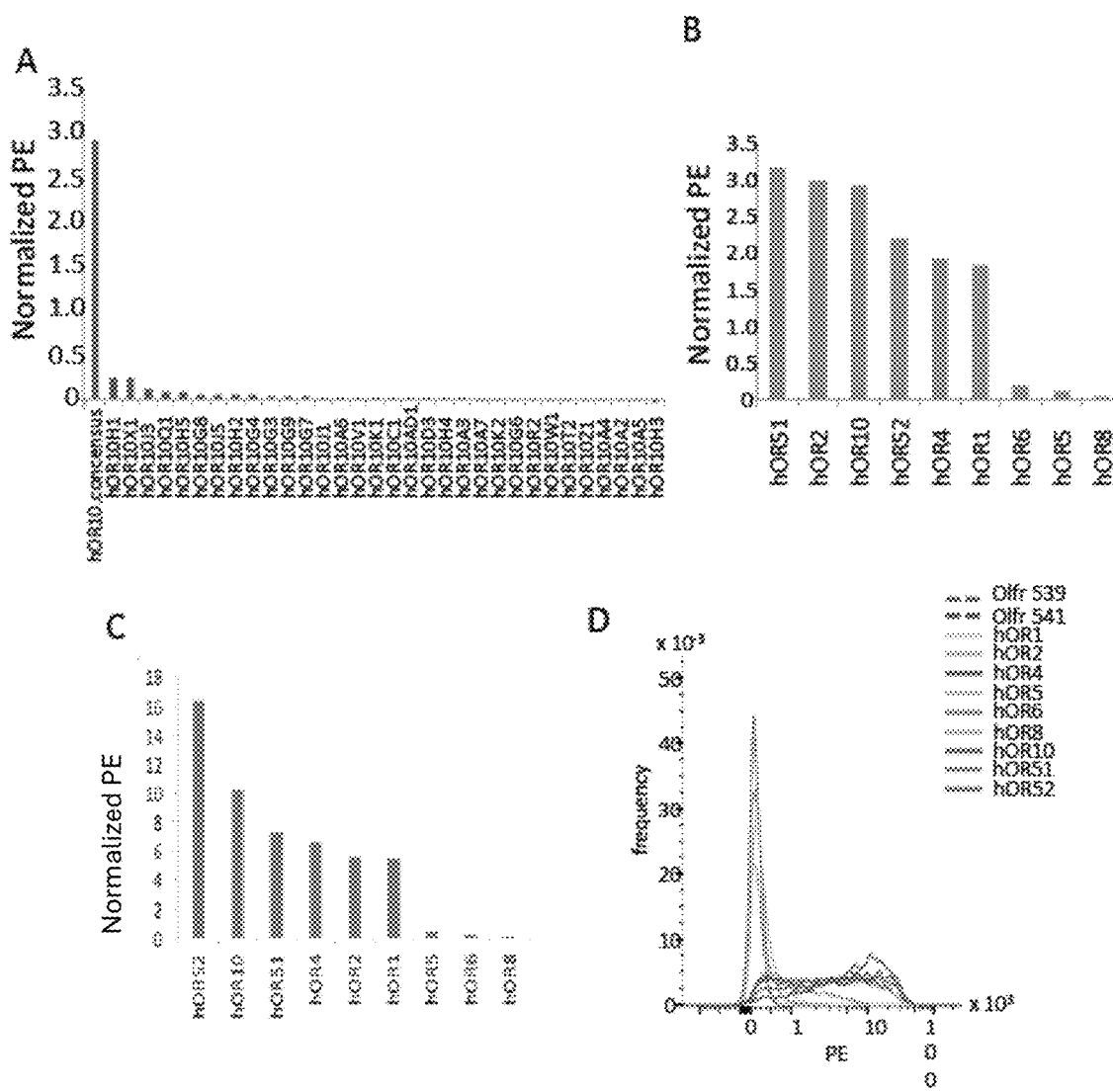
FIG. 9. Potential of consensus ORs for robust cell surface expression in the absence of RTP1S. (A) 32 hOR10 subfamily members and the consensus OR were transfected into HEK293T cells and the cell surface expression levels were measured. Cell surface expression levels of 9 consensus ORs (hOR1, hOR2, hOR4, hOR5, hOR6, hOR8, hOR10, hOR51 and hOR52) in (B) HEK293T or (C) NIH/3T3 cells. (D) 6 out of 9 consensus ORs (hOR1, hOR2, hOR4, hOR10, hOR51, hOR52) are robustly expressed in the cell surface of NIH/3T3 cells. (E) 32 hOR10subfamily members (cyan) and the consensus OR (red, duplicate) were transfected into HEK293T cells and their cell surface expression levels were measured by flowcytometry. (F) Usage rate of consensus residues at the 66 sites for consensus ORs (red) and all mouse ORs (black). (G) Ancestral tree of OR10 family member including OR10-consensus. (H) Dose-response curve of consensus ORs to candidate ligands ranging from 0 to 316 μM or 1 mM. Cells transfected with pCI vector were used as a negative control. n=3, error bars indicate SEM. (I) Ancestral tree of each human OR family including their corresponding consensus OR. Ancestral Parsimony trees are made based on the maximum parsimony score and the edge length are built according to the ACCTRAN criterion.
Figure 9E:
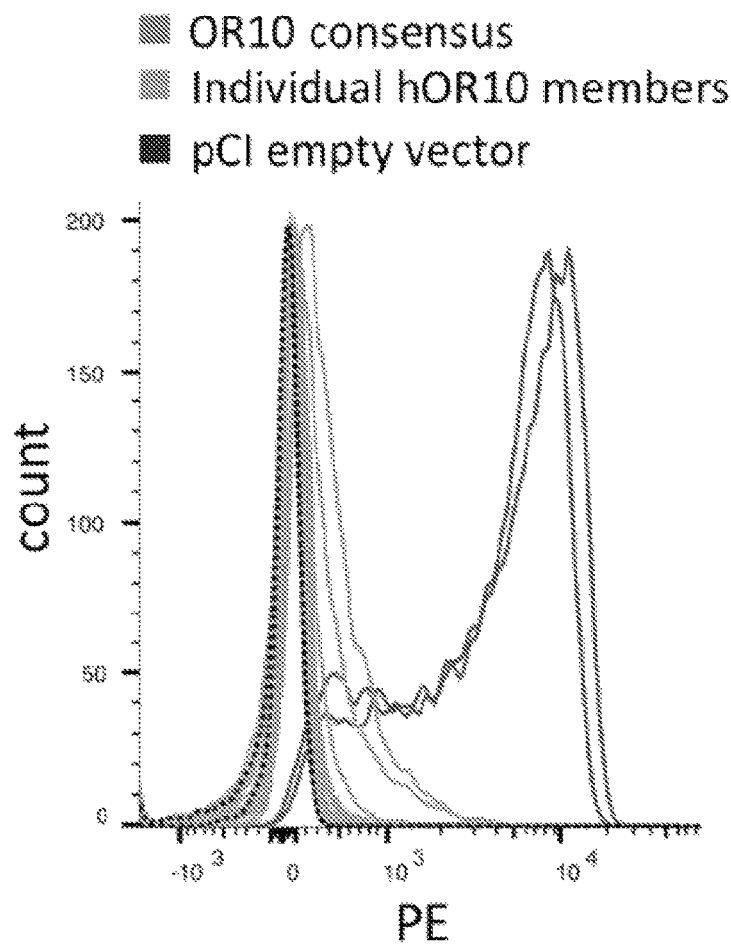

The above results suggest importance of consensus amino acid residues for cell surface expression. This idea led to a prediction that ORs that are designed based on consensus amino acids for each site would be efficiently trafficked to the cell surface. To test this, experiments were conducted that aligned amino acid sequences of human OR families and determined the consensus sequences as mostly frequently used amino acid residues at each position (see, FIGS. 14-22). OR10 family was first chosen to measure the cell surface expression levels of the consensus OR in HEK293T cells in comparison with each member of OR10 family. Strikingly, the consensus OR10 robustly expressed on the cell surface, more than any individual natural ORs tested (FIG. 9e), while 32 individual OR10 family members poorly expressed (FIG. 9a). 8 additional consensus human ORs (OR1, OR2, OR4, OR5, OR6, OR8, OR51 and OR52) were generated and the cell surface expression levels measured. In sum, 6 out of 9 consensus ORs show robust cell surface expression (FIG. 9b).

Figure 9F:
Figure 9G:
Figure 9H:
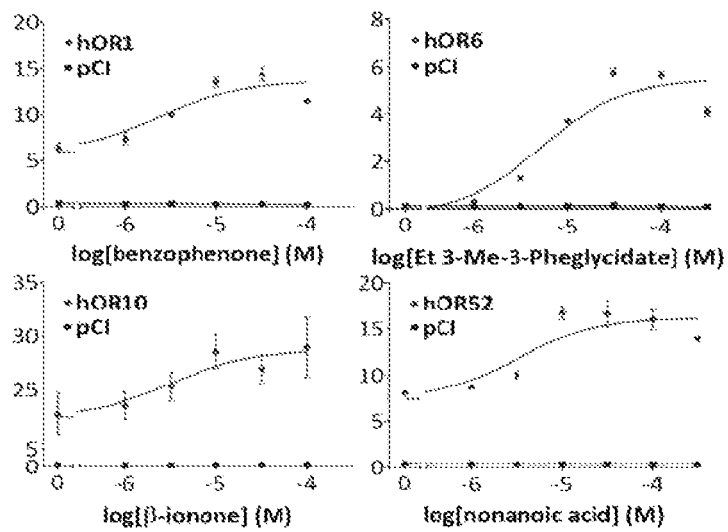
Figure 9I:
Figure 9I:
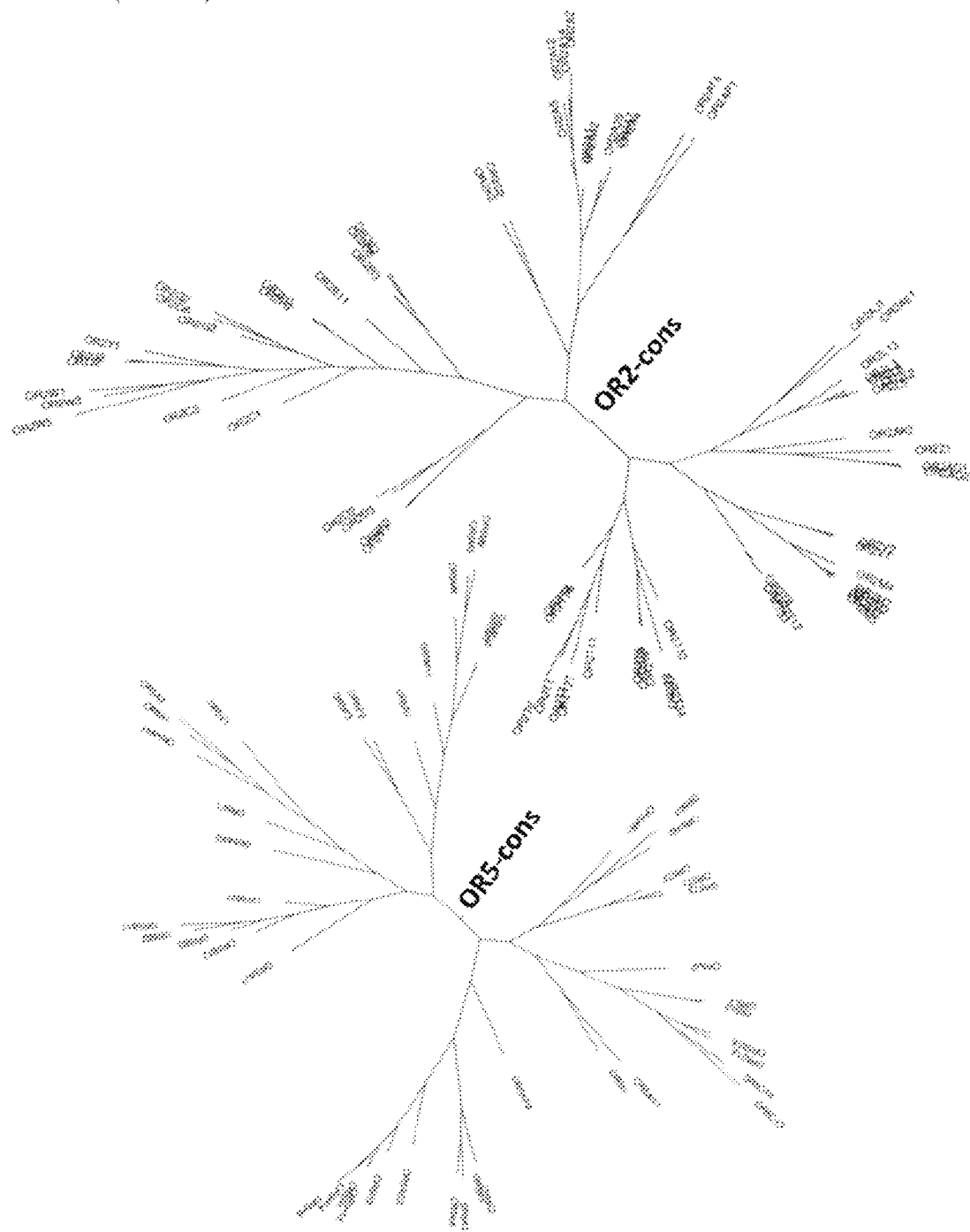
Figure 9I:
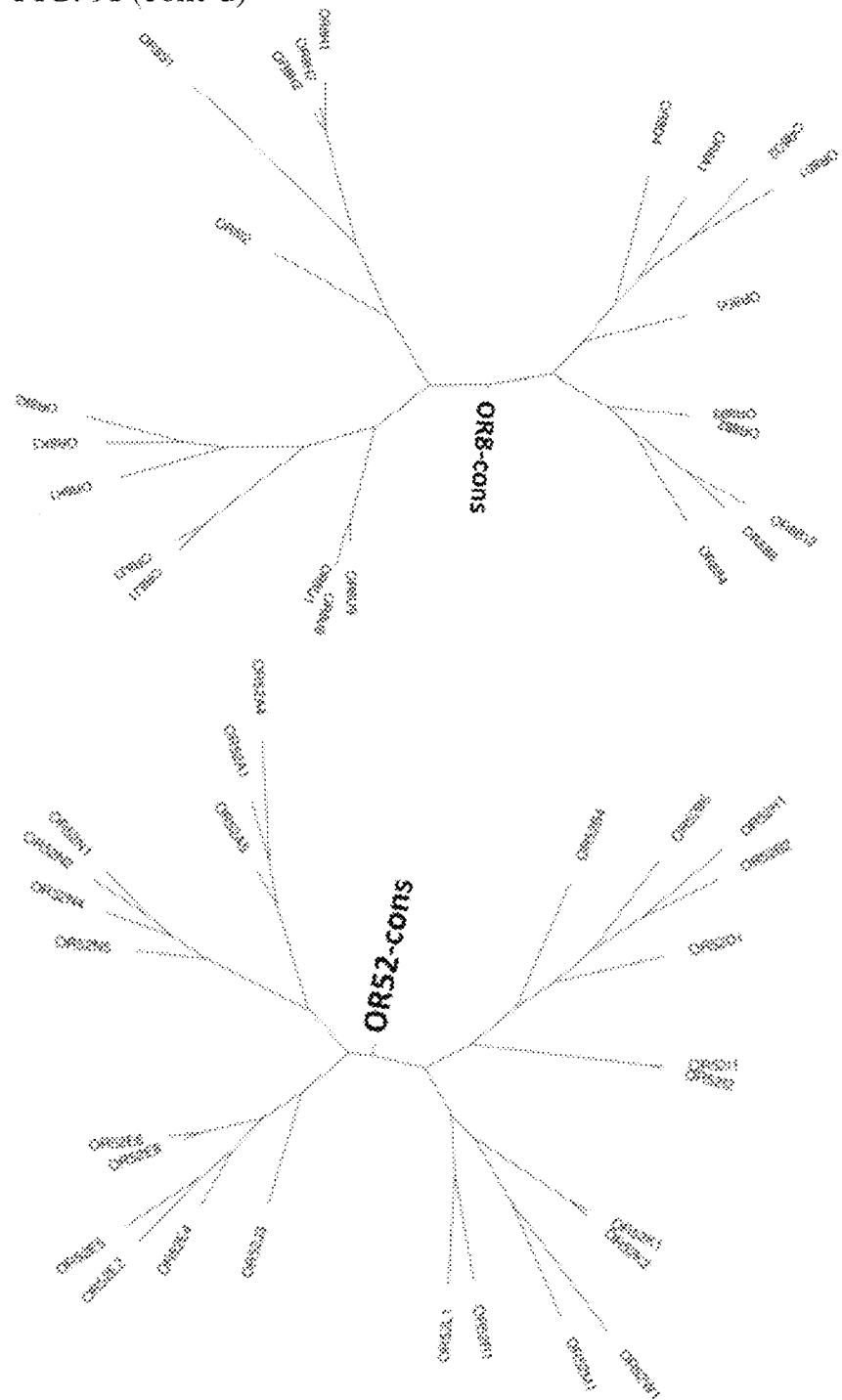
Figure 9I:
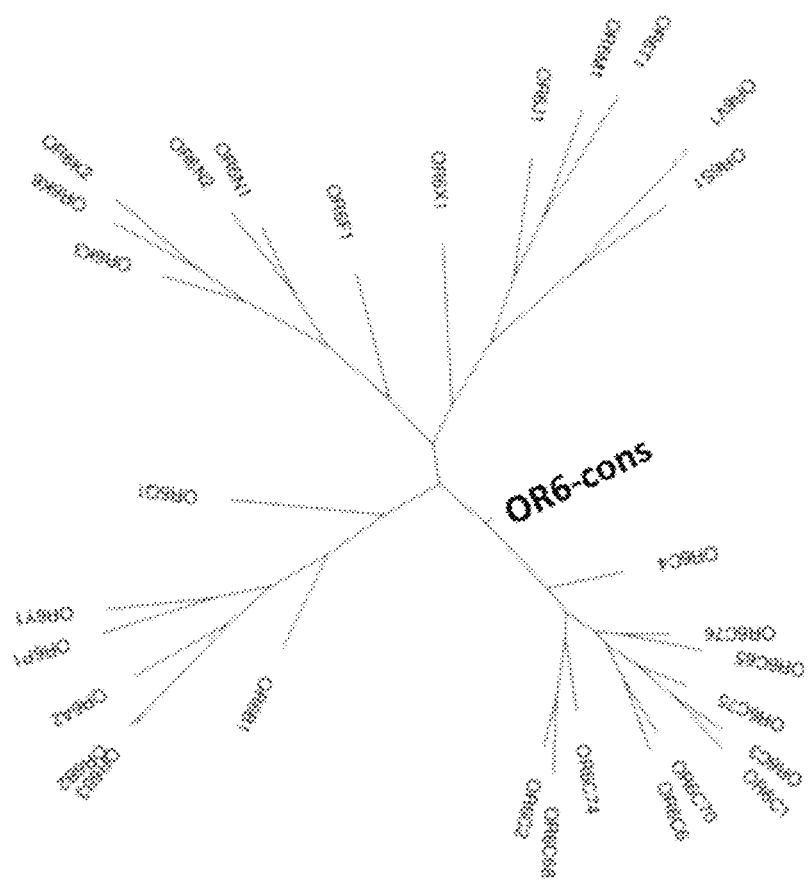

To exclude the possibility that this effect is specific to HEK293T cells which are derived from human embryonic kidney epithelial cells, the consensus ORs in NIH3T3 cells which are derived from mouse fibroblasts were expressed. FACS analysis indicated that most of the consensus ORs show robust cell surface expression, suggesting that these consensus ORs do not suffer from intracellular retention in multiple cell types (FIGS. 9c and 9d). The level of conservation of the 66 amino acid sites shown to be important for RTP independent OR expression were evaluated (FIG. 7E) between the consensus ORs and the mouse OR repertoire. Consensus ORs have the most common amino acid residues much more frequently represented than natural ORs (59 out of the 66 sites, p=4.70×10−94, chi-square test) (FIG. 9F). Phylogenetic trees were built using parsimony criterion for each OR family including the corresponding consensus OR and found that the consensus OR is always located at the origin of the tree (FIG. 9H, 9I).

Finally, it was asked whether the consensus receptors show functional expression. Experiments used cAMP-mediated luciferase reporter gene assay (see, Zhuang, H. & Matsunami, H. Nature protocols 3, 1402-1413 (2008)) to screen active ligands for the consensus ORs from a set of 320 diverse odorants. Robust ligands for OR1, OR6, OR10 and OR52 were identified, each of which show responses to specific subsets of the tested odorants (FIG. 10A, FIG. 9H). Such data indicates that these consensus ORs are functional, an indication of proper folding.

Figure 10:
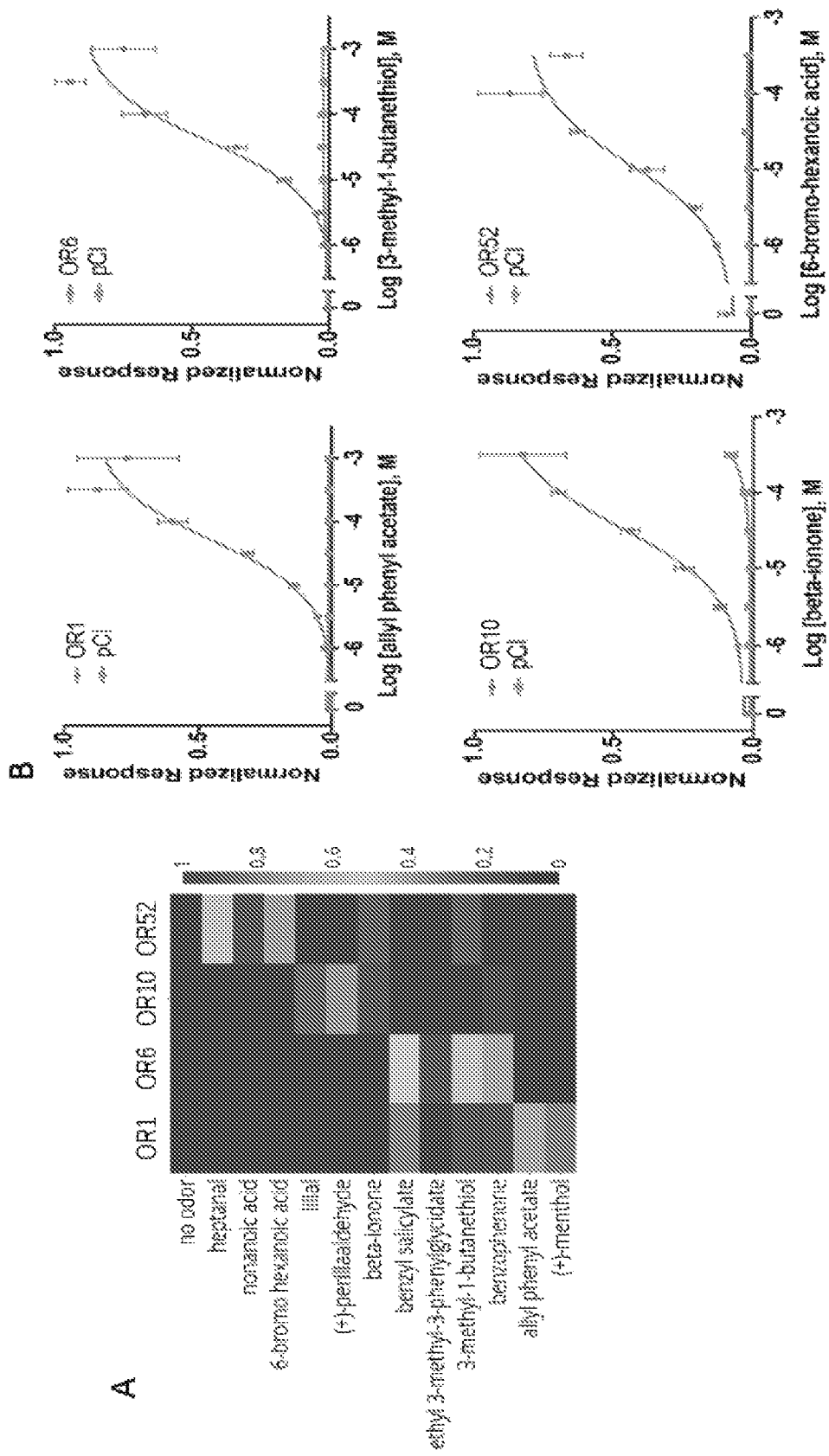
FIG. 10A-B. Consensus OR1, OR6, OR10 and OR52 are functionally expressed in Hana3A cells, as indicated by cAMP-mediated luciferase assays. (A) Heatmap of ORs responses to 30 uM odorant selected from a previously screened panel of 320 compounds. Luciferase activity was normalized for each OR by setting as 1.0 the highest response value, and 0 as the lowest response value. (B) Dose-response curve of consensus ORs to candidate ligands ranging from 0 to 316 uM or 1 mM. Cells transfected with pCI vector were used as a negative control. Luciferase activity was normalized by setting as 1.0 the highest response value, and 0 as the lowest response value of each experiment. n=3, error bars indicate SEM.
FIG. 10C-D-E-F. Improvement of OR expression by mutations in TM1 and Helix 8. (C) Homology model of hOR10. Each TM is highlighted in a colored tubes and residues D51 1.60, S52 1.61, H53 1.62 and E294 H8 are represented in licorice (pink). (D) Zoom on the residues 1.60, 1.61, 1.62, H8 mutated for hOR1 (red), hOR10 (blue), hOR51 (green) and hOR52 (pink). Ionic interactions between the residues are shown by dotted lines. (E) Expression analysis of hOR1, hOR10, hOR51, hOR52 and their mutant and the muscarinic receptor 3 (M3) at 1, 10 and 100 pg/μL of DNA in the transfection mix. (F) Dose-response curve of hOR10 and hOR52 and their mutant at different DNA concentration (from 0.001 to 100 in pg/μL of transfection mix) to β-ionone and nonanoic.

FIG. 10 shows consensus OR1, OR6, OR10 and OR52 are functionally expressed in Hana3A cells, as indicated by cAMP-mediated luciferase assays. (A) Heatmap of ORs responses to 30 uM odorant selected from a previously screened panel of 320 compounds. Luciferase activity was normalized for each OR by setting as 1.0 the highest response value, and 0 as the lowest response value. (B) Dose-response curve of consensus ORs to candidate ligands ranging from 0 to 316 uM or 1 mM. Cells transfected with pCI vector were used as a negative control. Luciferase activity was normalized by setting as 1.0 the highest response value, and 0 as the lowest response value of each experiment. n=3, error bars indicate SEM.

The consensus ORs already show a clear increase of cell surface expression in comparison to naturally-occurring ORs. Since it was observed that the expression of an OR seems to be correlated with its stability and rigidity when inserted in a membrane using molecular dynamics simulations (FIGS. 3B, C and D), experiments attempted to further improve the expression level of the consensus ORs by engineering salt bridges in the structures guided by 3D homology models (FIG. 10C). Thermostabilization studies on β1-adrenergic receptor 28 and chemokine receptor 21 showed that tightening of interactions between intracellular loop1 (ICL1) and the helix8 improved the GPCR stabilization. Another study (see, Kiefer, H. et al. Biochemistry 35, 16077-16084 (1996)) showed that enriching the number of basic residues in the intracellular loops of an OR enhances its expression. Based on these premises, experiments inserted triple Arg mutations in intracellular loop 1 (ICL1) to promote salt bridge interactions between ICL1 and helix8 in four human consensus ORs, namely OR1, OR10, OR51 and OR52 (FIG. 10D). Experiments evaluated the cell surface expression of the consensus ORs with their corresponding triple Arg mutants, including a well-studied non-olfactory class A GPCR, the muscarinic 3 receptor (M3) (FIG. 10E). Experiments observed enhanced expression of OR10 and OR52 mutants which are comparable to the expression level of the M3 receptor even when the amount of DNA used in transfection was changed by 100-fold. However, experiments did not observe any enhancement in expression level of mutant OR1 and OR51. The insertion of such stabilizing interactions improves the rigidity of the OR structure that might aid expression (see, de March, C. A., et al., Protein Science 24, 1543-1548, doi:10.1002/pro.2717 (2015); de March, C. A. et al. Angewandte Chemie 130, 4644-4648 (2018)). Experiments tested their functionality in comparison to their corresponding OR consensus (FIG. 10F). Mut-OR10 and Mut-OR52 both responded to their agonists (β-ionone and nonanoic acid respectively). Mut-OR52 showed activity similar to the consensus OR52, but the response of Mut-OR10 was diminished compared to OR10. For both OR10/Mut-hOR10 and OR52/Mut-OR52, decreasing the amount of transfected DNA by 10-100 fold compared with optimized amount for natural ORs resulted in robust responses against tested odorants, showing the capacity of these consensus ORs in supporting high levels of functional expression.

FIG. 12 shows RTP1S enhances cell surface expression of wild types of RTP-independent ORs.

FIG. 13 shows amino acids of RTP-independent ORs and RTP-dependent ORs are not statistically different in their polarity and hydrophobicity (p=0.74 and p=0.71, respectively).

Example VI

This example describes the materials and methods used in conducting the experiments described in Examples I-V.
Generating Chimeras and Mutants of ORs
  DNA fragments of OR genes were amplified by Phusion polymerase (Finnzymes). The fragments were mixed and amplified by PCR reaction to obtain full sequences.
Designing Consensus ORs
  Protein sequences of human ORs were downloaded from The Human Olfactory Data Explorer (HORDE) webpage (https://genome.weizmann.ac.il/horde/). The protein sequences were aligned using MAFFT. Mostly frequently used amino acid residues were defined as consensus residues at each position. The consensus amino acid sequences were translated into DNA sequences using Codon Optimization Tool on Integrated DNA Technologies (IDT) webpage.
DNA and Vector Preparation.
  Open reading frames of OR genes were subcloned into pCI (Promega) with a Rho tag at the N terminal. All plasmid sequences were verified using Sanger's sequencing (3100 Genetic Analyzer, Applied Biosystems).

Cell Culture.

HEK293T and Hana 3A cells were grown in Minimal Essential Medium (MEM) containing 10% FBS (vol/vol) with penicillin-streptomycin and amphotericin B. NIH/3T3 cells were grown in high glucose Dulbecco's Modified Eagle Medium (DMEM) supplemented with 10% CS, penicillin-streptomycin and amphotericin B. All cell lines were incubated at 37° C., saturating humidity and 5% C02.

FACS Analyses.

HEK293T cells were grown to confluency, resuspended and seeded onto 35 mm plates at 25% confluency. The cells were cultured overnight. A rho tagged OR in the plasmid pCI and GFP expression vector were transfected using Lipofectamine 2000. After 18-24 hours, the cells were resuspended by cell stripper and then kept in 5 mL round bottom polystyrene (PS) tubes (Falcon 2052) on ice. The cells were spun down at 4° C. and resuspended in PBS containing 15 mM NaN3, and 2% FBS to wash the cell stripper. They were subjected to keeping in primary antibody (mouse anti Rho (see, Laird, D. W. & Molday, R. S Investigative ophthalmology & visual science 29, 419-428 (1988)) and then washed, stained with phycoerythrin (PE)-conjugated donkey anti-mouse antibody (Jackson Immunologicals) in the dark. To stain dead cells, 7-Amino-actinomycin D (Calbiochem) was added. The cells were analyzed using BD FACSCanto II FACS with gating allowing for GFP positive, single, spherical, viable cells, and the measured PE intensities were analyzed and visualized using Flowjo (see, Dey, S. & Matsunami, H. Proceedings of the National Academy of Sciences of the United States of America 108, 16651-16656 (2011)). Experiments normalized the surface expression levels by cells expressing Olfr539, which was robustly expressed on the cell surface, and cells expressing Olfr541, which showed no detectable cell surface expression.

OR Protein Sequence Analyses.

Protein sequences of 1092 mouse ORs were aligned by Clustal Omega with default parameters. Conservation degree of amino acid residues was visualized by WebLogo (Crooks GE, 2004).

To identify the amino acid residues involved in RTP dependence, Grantham distances were calculated for all pairs of ORs at each position. The positions where Grantham distances of RTP-independent ORs were significantly shorter than those of all ORs were searched by one-sided t-tests followed by Bonferroni correction.

Homology Model Building

The protocol follows a previously published method (Charlier et al., 2013, de March et al. Protein science, 2015). Aligned protein sequences of mouse 1092 ORs are manually aligned to pre-aligned protein sequences of 11 GPCRs including bovine rhodopsin (PDB: 1U19), human chemokine receptors CXCR4 (PDB: 3ODU) and CXCR1 (PDB: 2LNL), and human adenosine a2A receptor (PDB: 2YDV) using Jalview.

Four experimental GPCR structures (1U19, 3ODU, 2YDV and 2LNL) are used as templates to build Olfr539 and its mutants (G154C, V209G, and L155A) and Olfr541 and its mutants (C154G and C154G/G209V) by homology modeling with Modeller. Five models are obtained and the one fulfilling several constraints (binding cavity sufficiently large, no large folded structure in extracellular loops, all TMs folded as α-helices, a small α-helix structure between TM3 and TM4) is kept for further molecular dynamics simulations.

Molecular Dynamics Simulations

The models were embedded in a model membrane made-up of POPC lipids solvated by TTP3P water molecules using Maestro. The total system is made up of ~48,650 atoms in a periodic box of $91*89*98$ Å$^3$.

Molecular dynamics simulations are performed with sander and pmemd.cuda modules of AMBER12 with the ff03 force-field for the protein and the gaff.lipid for the membrane. Hydrogen atoms bond are constrained by SHAKE algorithm and long-range electrostatics interactions are handled with Particle Mesh Ewald (PME). The cutoff for non-bonded interactions is set at 8 Å. Temperature and pressure are maintained constant with a Langevin thermostat with a collision frequency of 2 ps$^{-1}$. In addition, a weak coupling anisotropic algorithm with a relaxation time of 1 ps$^{-1}$ is applied. Snapshots are saved every 20 ps.

Two energy minimizations are performed during 10,000 steps with the 5,000 first steps using a conjugate gradient algorithm. The first one is run with a restraint of 200 kcal·mol$^{-1}$ applied on all atoms of the membrane and water and the second one with the same restraint on all atoms of the receptor. This last constraint is kept for the heating phase of 20 ps (NTP, 100K to 310K, Langevin thermostat with collision frequency of 5 ps$^{-1}$) and equilibration of 15 ns (NTP, 310K). Restraints are then reduced by 5 kcal·mol$^{-1}$ Å$^{-2}$ and another cycle of minimization-equilibration is performed. The systems (Olfr539 models (wt, G154C, V209G and L155A) and Olfr541 models (wt, C154G and C154G/G209V)) are replicated six times and 525 ns-long production molecular dynamics are performed after an equilibration period of 50 ns. RMSDs of seven transmembrane domains were calculated using CPPTRAJ in AmberTools. The RMSDs are between initial positions and each frame in the production step. 3D structures were visualized using VMD.

INCORPORATION BY REFERENCE

The entire disclosure of each of the patent documents and scientific articles referred to herein is incorporated by reference for all purposes.

EQUIVALENTS

The invention may be embodied in other specific forms without departing from the spirit or essential characteristics thereof. The foregoing embodiments are therefore to be considered in all respects illustrative rather than limiting the invention described herein. Scope of the invention is thus indicated by the appended claims rather than by the foregoing description, and all changes that come within the meaning and range of equivalency of the claims are intended to be embraced therein.

SEQUENCE LISTING (344 sequences)

SEQ ID NO: 1 - protein, 312 aa, Artificial sequence
  synthetic
MMMLRLNQTEVTEFVLEGFSEHPDLRLFLIGCFLSLYMMALMGNIVIIALVTSSTGLHSPMYFFLCNLATMDIVCTSSVIPKALVGLVSGENTISFKGCMAQLFFLVWSASSELLLLTVMAYDRYVAICFPLHYSSRMSPQLCGALAVGVWSICALNASVHTGLMTRLSFCGPKIITHFFCEIPPLLLLSCSPTYINSVMTLVADAFYGGINFVLTLLSYGYIIGSILRMRSAEGKRKAFSTCSSHLIVVSVYYSSVFCAYVSPASSYSPERSKVSSVLYSVLSPTLNPLIYTLRNKDVKLALGRILPSFSH

SEQ ID NO: 2 - protein, 312 aa, Artificial sequence
  synthetic
MMMLRLNQTEVTEFVLEGFSEHPDLRLFLIGCFLSLYMMALMGNIVIIALVTSSTGLHSPMYFFLCNLATMDIVCTSSVIPKALVGLVSGENTISFKGCMAQLFFLVWSASSELLLLTVMAYDRYVAICFPLHYSSRMSPQLCGALAVGVWSIGALNASVHTGLMTRLSFCGPKIITHFFCEIPPLLLLSCSPTYINSVMTLVADAFYVGINFVLTLLSYGYIIGSILRMRSAEGKRKAFSTCSSHLIVVSVYYSSVFCAYVSPASSYSPERSKVSSVLYSVLSPTLNPLIYTLRNKDVKLALGRILPSFSH

SEQ ID NO: 3 - protein, 310 aa, Artificial sequence
  synthetic
MEGENQSSVSEFLLLGLSSQPEQQNLLFALFLSMYLVTVLGNLLIILAISSDSHLHTPMYFFLSNLSFTDICFSSVTVPKMLVNIQTQSKSISYAGCLTQMYFFIAFGNLDSFLLAVMAYDRYVAICHPLHYTTIMSPRLCVLLVALSWVLSNLHALLHTLLMARLSFCASNEIPHFFCDLSPLLKLSCSDTHVNELVIFTEGLLVIVTPFLCILVSYVRIVSTVLKIPSAKGKWKAFSTCGSHLTVVSLFYGTIIGVYFQPLSTYSVKDTVATVMYTVVTPMLNPFIYSLRNKDMKGALRKLLSRRKSS

SEQ ID NO: 4 - protein, 312 aa, Artificial sequence
  synthetic
MSGTNQSSVSEFLLLGLSRQPQQQHLLFVFFLSMYLATVLGNLLIILSVSIDSCLHTPMYFFLSNLSFVDICFSFTTVPKMLANHILETQTISFCGCLTQMYFVFMFVDMDNFLLAVMAYDHFVAVCHPLHYTAKMTHQLCALLVAGLWVVANLNVLLHTLLMAPLSFCADNAITHFFCDVTPLLKLSCSDTHLNEVIILSEGALVMITPFLCILASYMHITCTVLKVPSTKGRWKAFSTCGSHLAVVLLFYSTIIAVYFNPLSSHSAEKDTMATVLYTVVTPMLNPFIYSLRNRYLKGALKKVVGRVVFSV

SEQ ID NO: 5 - protein, 314 aa, Artificial sequence
  synthetic
MMGQNQTSISDFLLLGLPIQPEQQNLCYALFLAMYLTTLLGNLLIIVLIRLDSHLHTPMYLFLSNLSFSDLCFSSVTIPKLLQNMQNQDPSIPYADCLTQMYFFLLFGDLESFLLVAMAYDRYVAICFPLHYTAIMSPMLCLALVALSWVLTTFHAMLHTLLMARLCFCADNVIPHFFCDMSALLKLAFSDTRVNEWVIFIMGGLILVIPFLLILGSYARIVSSILKVPSSKGICKAFSTCGSHLSVVSLFYGTVIGLYLCSSANSSTLKDTVMAMMYTVVTPMLNPFIYSLRNRDMKGALSRVIHQKKTFFSL

SEQ ID NO: 6 - protein, 323 aa, Artificial sequence
  synthetic
MMGQNQTSISDFLLLGLPIQPEQQNLCYALFLAMYLTTLLGNLLIIVLIRLDSHLHTPVYLFLSNLSFSDLCFSSVTMPKLLQNMQNQDPSIPYADCLTQMYFFLYFSDLESFLLVAMAYDRYVAICFPMHYTAICFLLHYTAIMSPMLCLSVVALSWVLTTFHAMLHTLLMARLCFCADNVIPHFFCDMSALLKLACSDTRVNEWVIFIMGGLILVIPFLLILGSYARIVSSILKVPSSKGICKAFSTCGSHLSVVSLFYGTVIGLYLCPSANSSTLKDTVMAMMYTVVTPMLTPFIYSLRNRDMKGALERVICKRKNPFLL

SEQ ID NO: 7 - protein, 306 aa, Artificial sequence
  synthetic
MSPENQSSVSEFLLLGLPIRPEQQAVFFALFLGMYLTTVLGNLLIMLLIQLDSHLHTPMYFFLSHLALTDISFSSVTVPKMLMNMQTQHLAVFYKGCISQTYFFIFFADLDSFLITSMAYDRYVAICHPLHYATIMTQSQCVMLVAGSWVIACACALLHTLLLAQLSFCADHIIPHYFCDLGALLKLSCSDTSLNQLAIFTAALTAIMLPFLCILVSYGHIGVTILQIPSTKGICKALSTCGSHLSVVTIYYRTIIGLYFLPPSSNTNDKNIIASVIYTAVTPMLNPFIYSLRNKDIKGALRKLLS

SEQ ID NO: 8 - protein, 313 aa, Artificial sequence
  synthetic
MSPENQSSVSEFLLLGLPIRPEQQAVFFTLFLGMYLTTVLGNLLIMLLIQLDSHLHTPMYFFLSHLALTDISFSSVTVPKMLMDMRTKYKSILYEECISQMYFFIFFTDLDSFLITSMAYDRYVAICHPLHYTVIMREELCVFLVAVSWILSCASSLSHTLLLTRLSFCAANTIPHVFCDLAALLKLSCSDIFLNELVMFTVGVVVITLPFMCILVSYGYIGATILRVPSTKGIHKALSTCGSHLSVVSLYYGSIFGQYLFPTVSSSIDKDVIVALMYTVVTPMLNPFIYSLRNRDMKEALGKLFSRATFFSW

SEQ ID NO: 9 - protein, 313 aa, Artificial sequence
  synthetic
MKRENQSSVSEFLLLDLPIWPEQQAVFFTLFLGMYLITVLGNLLIILLIRLDSHLHTPMFFFLSHLALTDISLSSVTVPKMLLSMQTQDQSILYAGCVTQMYFFIFFTDLDNFLLTSMAYDRYVAICHPLRYTTIMKEGLCNLLVTVSWILSCTNALSHTLLLAQLSFCADNTIPHFFCDLVALLKLSCSDISLNELVIFTVGQAVITLPLICILISYGHIGVTILKAPSTKGIFKALSTCGSHLSVVSLYYGTIIGLYFLPSSSASSDKDVIASVMYTVITPLLNPFIYSLRNRDIKGALERLFNRATVLSQ

SEQ ID NO: 10 - protein, 311 aa, Artificial sequence
  synthetic
MENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 11 - protein, 316 aa, Artificial sequence
  synthetic
MGKPGRVNQTTVSDFLLLGLSEWPEEQPLLFGIFLGMYLVTMVGNLLIILAISSDPHLHTPMYFFLANLSLTDACFTSASIPKMLANIHTQSQIISYSGCLAQLYFLLMFGGLDNCLLAVMAYDRYVAICQPLHYSTSMSPQLCALMLGVCWVLTNCPALMHTLLLTRVAFCAQKAIPHFYCDPSALLKLACSDTHVNELMIITMGLLFLTVPLLLIVFSYVRIFWAVFVISSPGGRWKAFSTCGSHLTVVLLFYGSLMGVYLLPPSTYSTERESRAAVLYMVIIPTLNPFIYSLRNRDMKEALGKLFVSGKTFFL

SEQ ID NO: 12 - protein, 313 aa, Artificial sequence
  synthetic
MEPRNQTSASQFILLGLSEKPEQETLLFSLFFCMYLVMVVGNLLIILAISIDSHLHTPMYFFLANLSLVDFCLATNTIPKMLVSLQTGSKAISYPCCLIQMYFFHFFGIVDSVIIAMMAYDRFVAICHPLHYAKIMSLRLCRLLVGALWAFSCFISLTHILLMARLVFCGSHEVPHYFCDLTPILRLSCTDTSVNRIFILIVAGMVIATPFVCILASYARILVAIMKVPSAGGRKKAFSTCSSHLSVVALFYGTTIGVYLCPSSVLTTVKEKASAVMYTAVTPMLNPFIYSLRNRDLKGALRKLVNRKITSSS

SEQ ID NO: 13 - protein, 307 aa, Artificial sequence
  synthetic
MEGKNQTNISEFLLLGFSSWQQQQVLLFALFLCLYLTGLFGNLLILLAIGSDHCLHTPMYFFLANLSLVDLCLPSATVPKMLLNIQTQTQTISYPGCLAQMYFCMMFANMDNFLLTVMAYDRYVAICHPLHYSTIMALRLCASLVAAPWVIAILNPLLHTLMMAHLHFCSDNVIHHFFCDINSLLPLSCSDTSLNQLSVLATVGLIFVVPSVCILVSYILIVSAVMKVPSAQGKLKAFSTCGSHLALVILFYGAITGVYMSPLSNHSTEKDSAASVIFMVVAPVLNPFIYSLRNNELKGTLKKTLSR

SEQ ID NO: 14 - protein, 309 aa, Artificial sequence
  synthetic
MERINHTSSVSEFILLGLSSRPEDQKTLFVLFLIVYLVTITGNLLIILAIRFNPHLQTPMYFFLSFLSLTDICFTTSVVPKMLMNFLSEKKTISYAGCLTQMYFLYALGNSDSCLLAVMAFDRYVAVCDPFHYVTTMSHHHCVLLVAFSCSFPHLHSLLHTLLLNRLTFCDSNVIHHFLCDLSPVLKLSCSSIFVNEIVQMTEAPIVLVTRFLCIAFSYIRILTTVLKIPSTSGKRKAFSTCGFYLTVVTLFYGSIFCVYLQPPSTYAVKDHVATIVYTVLSSMLNPFIYSLRNKDLKQGLRKLMSKRS

SEQ ID NO: 15 - protein, 310 aa, Artificial sequence
  synthetic
MGRNNLTRPSEFILLGLSSRPEDQKPLFAVFLPIYLITVIGNLLIILAIRSDTRLQTPMYFFLSILSFVDICYVTVIIPKMLVNFLSETKTISYSECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYLYFQPLSNYTVKDQIATIIYTVLTPMLNPFIYSLRNKDMKQGLAKLMHRMKCQ

SEQ ID NO: 16 - protein, 324 aa, Artificial sequence
  synthetic
MGMSNLTRLSEFILLGLSSRSEDQRPLFALFLIIYLVTLMGNLLIILAIHSDPRLQNPMYFFLSILSFADICYTTVIVPKMLVNFLSEKKTISYAECLAQMYFFLVFGNIDSYLLAAMAINRCVAICNPFHYVTVMNRRCCVLLLAFPITFSYFHSLLHVLLVNRLTFCTSNVIHHFFCDVNPVLKLSCSSTFVNEIVAMTEGLASVMAPFVCIIISYLRILIAVLKIPSAAGKHKAFSTCSSHLTVVILFYGSISYVYLQPLSSYTVKDRIATINYTVLTSVLNPFIYSLRNKDMKRGLQKLINKIKSQMSRFSTKTNKICGP

SEQ ID NO: 17 - protein, 311 aa, Artificial sequence
  synthetic
METKNYSSSTSGFILLGLSSNPKLQKPLFAIFLIMYLLTAVGNVLIILAIYSDPRLHTPMYFFLSNLSFMDICFTTVIVPKMLVNFLSETKIISYVGCLIQMYFFMAFGNTDSYLLASMAIDRLVAICNPLHYDVVMKPWHCLLMLLGSCSISHLHSLFRVLLMSRLSFCASHIIKHFFCDTQPVLKLSCSDTSSSQMVVMTETLAVIVTPFLCTIFSYLQIIVTVLRIPSAAGKWKAFSTCGSHLTVVVLFYGSVIYVYFRPLSMYSVMKGRVATVMYTVVTPMLNPFIYSLRNKDMKRGLKKLRHRIYS

SEQ ID NO: 18 - protein, 311 aa, Artificial sequence
  synthetic
MEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 19 - protein, 313 aa, Artificial sequence
  synthetic
MEGKNLTSISECFLLGFSEQLEEQKPLFGSFLFMYLVTVAGNLLIILVIITDTQLHTPMYFFLANLSLADACFVSTTVPKMLANIQIQSQAISYSGCLLQLYFFMLFVMLEAFLLAVMAYDCYVAICHPLHYILIMSPGLCIFLVSASWIMNALHSLLHTLLMNSLSFCANHEIPHFFCDINPLLSLSCTDPFTNELVIFITGGLTGLICVLCLIISYTNVFSTILKIPSAQGKRKAFSTCSSHLSVVSLFFGTSFCVDFSSPSTHSAQKDTVASVMYTVVTPMLNPFIYSLRNQEIKSSLRKLIWVRKIHSP

SEQ ID NO: 20 - protein, 312 aa, Artificial sequence
  synthetic
MHQENQTTITEFILLGLSNQAEHQNLLFVLFLSMYVVTVVGNGLIIVAISLDIYLHTPMYLFLAYLSFADISSISNSVPKMLVNIQTNSQSISYESCITQMYFSIVFVVTDNLLLGTMAFDHFVAICHPLNYTTFMRARFGTLLTVISWFLSNIIALTHTLLLIQLLFCDHNTLPHFFCDLAPLLKLSCSDTMINELVLFIVGLSVIIFPFVLIFFSYVCIIRAVLGVSSTQGKWKAFSTCGSHLTIALLFYGTTVGVYFFPSSTHPEDTDKIGAVLFTVVTPMMNPFIYSLRNKDMKGALRKLINRKISSL

SEQ ID NO: 21 - protein, 312 aa, Artificial sequence
  synthetic
MHQGNQTTITEFILLGFFKQDEHQNLLFVLFLGMYLVTVIGNGLIIVAISLDTYLHTPMYLFLANLSFADISSISNSVPKMLVNIQTKSQSISYESCITQMYFSIVFVVIDNLLLGTMAYDHFVAICHPLNYTILMRPRFGILLTVISWFLSNIIALTHTLLLIQLLFCNHNTLPHFFCDLAPLLKLSCSDTLINELVLFIVGLSVIIFPFTLSFFSYVCIIRAVLRVSSTQGKWKAFSTCGSHLTVVLLFYGTIVGVYFFPSSTHPEDTDKIGAVLFTVVTPMINPFIYSLRNKDMKGALRKLINRKISSL

SEQ ID NO: 22 - protein, 312 aa, Artificial sequence
  synthetic
MDGDNQSENSQFLLLGISESPEQQRILFWMFLSMYLVTVLGNVLIILAISSDSHLHTPMYFFLANLSFTDLFFVTNTIPKMLVNFQSQNKAISYAGCLTQLYFLVSLVTLDNLILAVMAYDRYVATCCPLHYVTAMSPGLCVLLLSLCWGLSVLYGLLLTFLLTRVTFCGPREIHYLFCDMYILLWLACSNTHIIHTALIATGCFIFLTPLGFMTTSYVRIVRTILQMPSASKKYKTFSTCASHLGVVSLFYGTLAMVYLQPLHTYSMKDSVATVMYAVLTPMMNPFIYRLRNKDMHGAPGRVLWRPFQRPK

SEQ ID NO: 23 - protein, 312 aa, Artificial sequence
  synthetic
  misc_feature (172)..(172): Xaa can be any naturally occurring amino acid
MDGDNQSENSQFLLLGISESPEQQQILFWMFLSMYLVTVLGNVLIILAISSDSHLHTPMYFFLANLSFTDLFFVTNTIPKMLVNFQSQNKAISYAGCLTQLYFLVSLVTLDNLILAVMAYDRYVAICCPLHYVTAMSPGLCVLLLSLCWGLSVLYGLLLTFLLTRVTFCGPXEIHYLFCDMYILLWLACSNTHIIHTVLIATGCFIFLTPLGFMTTSYVRIVRTILQMPSASKKYKTFSTCASHLGVVSLFYGMLAMVYLQPLHTYSMKDSVATVMYAVLTPMMNPFIYRLRNKDMHGAPGRVLWRPFQRPK

SEQ ID NO: 24 - protein, 312 aa, Artificial sequence
  synthetic
MDGGNQSEGSEFLLLGMSESPEQQRILFWMFLSMYLVTVVGNVLIILAISSDSRLHTPVYFFLANLSFTDLFFVTNTIPKMLVNLQSHNKAISYAGCLTQLYFLVSLVALDNLILAVMAYDRYVAICCPLHYTTAMSPKLCILLLSLCWVLSVLYGLIHTLLMTRVTFCGSRKIHYIFCEMYVLLRMACSNIQINHTVLIATGCFIFLIPFGFVIISYVLIIRAILRIPSVSKKYKAFSTCASHLGAVSLFYGTLCMVYLKPLHTYSVKDSVATVMYAVVTPMMNPFIYSLRNKDMHGALGRLLDKHFKRLT

SEQ ID NO: 25 - protein, 309 aa, Artificial sequence
  synthetic
MKKENQSFNLDFILLGVTSQQEQNNVFFVIFLCIYPITLTGNLLIILAICADIRLHNPMYFLLANLSLVDIIFSSVTIPKVLANHLLGSKFISFGGCLMQMYFMIALAKADSYTLAAMAYDRAVAISCPLHYTTIMSPRSCILLIAGSWVIGNTSALPHTLLTASLSFCGNQEVANFYCDIMPLLKLSCSDVHFNVKMMYLGVGVFSLPLLCIIVSYVQVFSTVFQVPSTKSLFKAFCTCGSHLTVVFLYYGTTMGMYFRPLTSYSPKDAVITVMYVAVTPALNPFIYSLRNWDMKAALQKLFSKRISS

SEQ ID NO: 26 - protein, 309 aa, Artificial sequence
  synthetic
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISRPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 27 - protein, 315 aa, Artificial sequence
  synthetic
MEPEKQTEISEFFLQGLSEKPEHQTLLFTMFLSTYLVTIIGNALIILAIITDSHLHTPMYFFLFNLSLVDTLLSSTTVPKMLANIQAQSRAIPFVGCLTQMYAFHLFGTMDSFLLAVMAIDRFVAIVHPQRYLVLMCSPVCGLLLGASWMITNLQSLIHTCLMAQLTFCAGSEISHFFCDLMPLLKLSGSDTHTNELVIFAFGIVVGTSPFSCILLSYIRIFWTVFKIPSTRGKWKAFSTCGLHLTVVSLSYGTIFAVYLQPTSPSSSQKDKAAALMCGVFIPMLNPFIYSIRNKDMKAALGKLIGKVAVPCPRP

SEQ ID NO: 28 - protein, 314 aa, Artificial sequence
  synthetic
MEKRNLTVVREFVLLGLPSSAEQQHLLSVLFLCMYLATTLGNMLIIATIGFDSHLHSPMYFFLSNLAFVDICFTSTTVPQMVVNILTGTKTISFAGCLTQLFFFVSFVNMDSLLLCVMAYDRYVAICHPLHYTARMNLCLCVQLVAGLWLVTYLHALLHTVLIAQLSFCASNIIHHFFCDLNPLLQLSCSDVSFNVMIIFAVGGLLALTPLVCILVSYGLIFSTVLKITSTQGKQRAVSTCSCHLSVVVLFYGTAIAVYFSPSSPHMPESDTLSTIMYSMVAPMLNPFIYTLRNRDMKRGLQKMLLKCTVFQQQ

SEQ ID NO: 29 - protein, 316 aa, Artificial sequence
  synthetic
MEAANESSEGISFVLLGLTTSPGQQRPLFVLFLLLYVASLLGNGLIVAAIQASPALHAPMYFLLAHLSFADLCFASVTVPKMLANLLAHDHSISLAGCLTQMYFFFALGVTDSCLLAAMAYDCYVAIRHPLPYATRMSRAMCAALVGMAWLVSHVHSLLYILLMARLSFCASHQVPHFFCDHQPLLRLSCSDTHHIQLLIFTEGAAVVVTPFLLILASYGAIAAAVLQLPSASGRLRAVSTCGSHLAVVSLFYGTVIAVYFQATSRREAEWGRVATVMYTVVTPMLNPIIYSLWNRDVQGALRALLIGRRISASDS

SEQ ID NO: 30 - protein, 314 aa, Artificial sequence
  synthetic
MDNSNWTSVSHFVLLGISTHPEEQIPLFLVFSLMYAINISGNLAIITLILSAPRLHIPMYIFLSNLALTDICFTSTTVPKMLQIIFSPTKVISYTGCLAQTYFFICFAVMENFILAVMAYDRYIAICHPFHYTMILTRMLCVKMVVMCHALSHLHAMLHTFLIGQLIFCADNRIPHFFCDLYALMKISCTSTYLNTLMIHTEGAVVISGALAFITASYACIILVVLRIPSAKGRWKTFSTCGSHLTVVAIFYGTLSWVYFRPLSSYSVTKGRIITVVYTVVTPMLNPFIYSLRNGDVKGGFMKWMSRMQTFFFR

SEQ ID NO: 31 - protein, 318 aa, Artificial sequence
  synthetic
MMSFAPNASHSPVFLLLGFSRANISYTLLFFLFLAIYLTTILGNVTLVLLISWDSRLHSPMYYLLRGLSVIDMGLSTVTLPQLLAHLVSHYPTIPAARCLAQFFFFYAFGVTDTLVIAVMALDRYVAICDPLHYALVMNHQRCACLLALSWVVSILHTMLRVGLVLPLCWTGDAGGNVNLPHFFCDHRPLLRASCSDIHSNELAIFFEGGFLMLGPCALIVLSYVRIGAAILRLPSAAGRRRAVSTCGSHLTMVGFLYGTIICVYFQPPFQNSQYQDMVASVMYTAITPLANPFVYSLHNKDVKGALCRLLEWVKVDP

SEQ ID NO: 32 - protein, 311 aa, Artificial sequence
  synthetic
MAARNHTTVTEFILTGLTDHPELQMPLFLLFLGIYLVTVVGNLGMITLIRLDSQLHTPMYFFLSNLSFIDLCYSSVITPKMLVNFLSKKNIISFVGCMTQLFFFLFFVISECYLLSSMAYDRYVAICNPLLYMVIMSPRVCLLLVAGPYVYGFLGALVHTGCMFRLSFCDSNIINHFFCDILPLLALSCSDTYINELVIFIIAGINLLVSLLTVLVSYAFILSSILRINSTEGRSKAFSTCSSHLLAVTIFYGSLIFMYLKPSSSHSLDQDKVASVFYTIVIPMLNPLIYSLRNKDVKNALKKTLIRRQFS

SEQ ID NO: 33 - protein, 313 aa, Artificial sequence
  synthetic
MLARNNSLVTEFILAGLTDHPEFRQPLFFLFLVIYIVTMVGNLGLITLFGLNSHLHTPMYYFLFNLSFIDLCYSSVFTPKMLMNFVSKKNIISNVGCMTRLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGTNITVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 34 - protein, 313 aa, Artificial sequence
  synthetic
MLARNNSLVTEFILAGLTDHPEFQQPLFFLFLVVYIVTMVGNLGLIILFGLNSHLHTPMYYFLFNLSFIDLCYSSVFTPKMLMNFVSKKNIISYVGCMTQLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGINIMVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 35 - protein, 311 aa, Artificial sequence
  synthetic
MAAENSSFVTQFILAGLTDQPGVQIPLFFLFLGFYVVTVVGNLGLITLIRLNSHLHTPMYFFLYNLSFIDFCYSSVITPKMLMSFVLKKNSISYAGCMTQLFFFLFFVVSESFILSAMAYDRYVAICNPLLYMVTMSPQVCFLLLLGVYGMGFAGAMAHTACMMGVTFCANNLVNHYMCDILPLLECACTSTYVNELVVFVVVGIDIGVPTVTIFISYALILSSIFHIDSTEGRSKAFSTCSSHIIAVSLFFGSGAFMYLKPFSLLAMNQGKVSSLFYTTVVPMLNPLIYSLRNKDVKVALKKILNKNAFS

SEQ ID NO: 36 - protein, 310 aa, Artificial sequence
  synthetic
MAAKNSSVTEFILEGLTHQPGLRIPLFFLFLGFYTVTVVGNLGLITLIGLNSHLHTPMYFFLFNLSLIDFCFSTTITPKMLMSFVSRKNIISFTGCMTQLFFFCFFVVSESFILSAMAYDRYVAICNPLLYTVTMSCQVCLLLLLGAYGMGFAGAMAHTGSIMNLTFCADNLVNHFMCDILPLLELSCNSSYMNELVVFIVVAVDVGMPIVTVFISYALILSSILHNSSTEGRSKAFSTCSSHIIVVSLFFGSGAFMYLKPLSILPLEQGKVSSLFYTIIVPVLNPLIYSLRNKDVKVALRRTLGRKIFS

SEQ ID NO: 37 - protein, 309 aa, Artificial sequence
  synthetic
MAAGNHSTVTEFILKGLTKRADLQLPLFLLFLGIYLVTIVGNLGMITLICLNSQLHTPMYYFLSNLSLMDLCYSSVITPKMLVNFVSEKNIISYAGCMSQLYFFLVFVIAECYMLTVMAYDRYVAICHPLLYNIIMSHHTCLLLVAVVYAIGLIGSTIETGLMLKLPYCEHLISHYFCDILPLMKLSCSSTYDVEMTVFFSAGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGKLF

SEQ ID NO: 38 - protein, 308 aa, Artificial sequence
  synthetic
MTMENYSMAAQFVLDGLTQQAELQLPLFLLFLGIYVVTVVGNLGMILLIAVSPLLHTPMYYFLSSLSFVDFCYSSVITPKMLVNFLGKKNTILYSECMVQLFFFVVFVVAEGYLLTAMAYDRYVAICSPLLYNAIMSSWVCSLLVLAAFFLGFLSALTHTSAMMKLSFCKSHIINHYFCDVLPLLNLSCSNTHLNELLLFIIAGFNTLVPTLAVAVSYAFILYSILHIRSSEGRSKAFGTCSSHLMAVVIFFGSITFMYFKPPSSNSLDQEKVSSVFYTTVIPMLNPLIYSLRNKDVKKALRKVLVGK

SEQ ID NO: 39 - protein, 311 aa, Artificial sequence
  synthetic
MATSNHSSGAEFILAGLTQRPELQLPLFLLFLGIYVVTVVGNLGMIFLIALSSQLYPPVYYFLSHLSFIDLCYSSVITPKMLVNFVPEENIISFLECITQLYFFLIFVIAEGYLLTAMEYDRYVAICRPLLYNIVMSHRVCSIMMAVVYSLGFLWATVHTTRMSVLSFCRSHTVSHYFCDILPLLTLSCSSTHINEILLFIIGGVNTLATTLAVLISYAFIFSSILGIHSTEGQSKAFGTCSSHLLAVGIFFGSITFMYFKPPSSTTMEKEKVSSVFYITIIPMLNPLIYSLRNKDVKNALKKMTRGRQSS

SEQ ID NO: 40 - protein, 314 aa, Artificial sequence
  synthetic
MGVKNHSTVTEFLLSGLTEQAELQLPLFCLFLGIYTVTVVGNLSMISIIRLNRQLHTPMYYFLSSLSFLDFCYSSVITPKMLSGFLCRDRSISYSGCMIQLFFFCVCVISECYMLAAMACDRYVAICSPLLYRVIMSPRVCSLLVAAVFSVGFTDAVIHGGCILRLSFCGSNIIKHYFCDIVPLIKLSCSSTYIDELLIFVIGGFNMVATSLTIIISYAFILTSILRIHSKKGRCKAFSTCSSHLTAVLMFYGSLMSMYLKPASSSSLTQEKVSSVFYTTVILMLNPLIYSLRNNEVRNALMKLLRRKISLSPG

SEQ ID NO: 41 - protein, 311 aa, Artificial sequence
  synthetic
MAAENHSFVTKFILVGLTEKSELQLPLFLVFLGIYVVTVLGNLGMITLIGLSSHLHTPMYCFLSSLSFIDFCHSTVITPKMLVNFVTEKNIISYPECMTQLYFFLVFAIAECHMLAAMAYDGYVAICSPLLYSIIISNKACFSLILVVYVIGLICASAHIGCMFRVQFCKFDVINHYFCDLISILKLSCSSTYINELLILIFSGINILVPSLTILSSYIFIIASILRIRYTEGRSKAFSTCSSHISAVSVFFGSAAFMYLQPSSVSSMDQGKVSSVFYTIVVPMLNPLIYSLRNKDVHVALKKTLGKRTFL

SEQ ID NO: 42 - protein, 309 aa, Artificial sequence
  synthetic
MAHINCTQATEFILVGLTDHQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKIIINKN

SEQ ID NO: 43 - protein, 308 aa, Artificial sequence
  synthetic
MAHINCTQATEFILVGLTDHQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFRLSYCHSNIVNHFYCDDMPLLRLTCSDTRFKQLWILACAGITFICSVLIVFVSYMFIIFAILRMSSAEGRRKAFSTCSSHMLAVTIFYGTLIFMYLQPSSSHSLDADKMASVFYTVIIPMLNPLIYSLRNKDVKDALKKVIINR

SEQ ID NO: 44 - protein, 305 aa, Artificial sequence
  synthetic
MTQINCTQVTEFILVGLTDRQELKMPLFVLFLSIYLFTVVGNLGLILLIRTDEKLNTPMYFFLSNLAFVDFCYSSVITPKMLGNFLYKQNSISFNACAAQLGCFLAFMTAECLLLASMAYDRYVAICNPLMYMVVMSPGICIQLVAAPHSYSILVALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKII

SEQ ID NO: 45 - protein, 309 aa, Artificial sequence
  synthetic
MTLRNSSSVTEFILVGLSEQPELQLPLFLLFLGIYVFTVVGNLGLITLIGINPSLHTPMYFFLFNLSFIDLCYSCVFTPKMLNDFVSESIISYVGCMTQLFFFCFFVNSECYVLVSMAYDRYVAICNPLLYMVTMSPRVCFLLMFGSYVVGFAGAMAHTGSMLRLTFCDSNVIDHYLCDVLPLLQLSCTSTHVSELVFFIVVGVITMLSSISIVISYALILSNILCIPSAEGRSKAFSTWGSHIIAVALFFGSGTFTYLTTSFPGSMNHGRFASVFYTNVVPMLNPSIYSLRNKDDKLALGKTLKRVLF

SEQ ID NO: 46 - protein, 312 aa, Artificial sequence
  synthetic
MMGRRNNTNVADFILMGLTLSEEIQMALFMLFLLIYLITMLGNVGMILIIRLDLQLHTPMYFFLTHLSFIDLSYSTVVTPKTLANLLTSNYISFTGCFAQMFFFAFLGTAECYLLSSMAHDRYAAICSPLHYTVIMSKRLCLALITGPYVIGFIDSFVNVVSMSRLHFYDSNVIHHFFCDTSPILALSCTDTYNTEILIFIIVGSTLMVSLFTISASYVFILFTILKINSTSGKQKAFSTCVSHLLGVTIFYSTLIFTYLKPRKSYSLGRDQVASVFYTIVIPVLNPLIYSLRNKEVKNAVIRVMQRRQDSR

SEQ ID NO: 47 - protein, 312 aa, Artificial sequence
  synthetic
MMGRRNDTNVADFILTGLSDSEEVQMALFMLFLLIYLITMLGNVGMLLIIRLDLQLHTPMYFFLTHLSFIDLSYSTVVTPKTLANLLTSNYISFTGCFAQMFCFVFLGTAECYLLSSMAYDRYAAICSPLHYTVIMPKRLCLALITGPYVIGFMDSFVNVVSMSRLHFCDSNIIHHFFCDTSPILALSCTDTDNTEMLIFIIAGSTLMVSLITISASYVSILSTILKINSTSGKQKAFSTCVSHLLGVTIFYGTMIFTYLKPRKSYSLGRDQVAPVFYTIVIPMLNPLIYSLRNREVKNALIRVMQRRQDSR

SEQ ID NO: 48 - protein, 311 aa, Artificial sequence
  synthetic
MGRRNNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRRQDSR

SEQ ID NO: 49 - protein, 310 aa, Artificial sequence
  synthetic
MAGNNFTEVTVFILSGFANHPELQVSLFLMFLFIYLFTVLGNLGLITLIRMDSQLHTPMYFFLSNLAFIDIFYSSTVTPKALVNFQSNRRSISFVGCFVQMYFFVGLVCCECFLLGSMAYNRYIAICNPLLYSVVMSQKVSNWLGVMPYVIGFTSSLISVWVISSLAFCDSSINHFFCDTTALLALSCVDTFGTEMVSFVLAGFTLLSSLLIITVTYIIIISAILRIQSAAGRQKAFSTCASHLMAVTIFYGSLIFTYLQPDNTSSLTQAQVASVFYTIVIPMLNPLIYSLRNKDVKNALLRVIHRKLFP

SEQ ID NO: 50 - protein, 315 aa, Artificial sequence
  synthetic
MAPENFTRVTEFILTGVSSCPELQIPLFLVFLVLYVLTMAGNLGIITLTSVDSRLQNPMYFFLRHLAIINLGNSTVIAPKMLMNFLVKKKTTSFYECATQLGGFLFFIVSEVMMLAVMAYDRYVAICNPLLYMVVVSRRLCLLLVSLTYLYGFSTAIVVSPCIFSVSYCSSNIINHFYCDIAPLLALSCSDTYIPETIVFISAATNLVFSMITVLVSYFNIVLSILRIRSPEGRKKAFSTCASHMIAVTVFYGTMLFMYLQPQTNHSLDTDKMASVFYTLVIPMLNPLIYSLRNNDVNVALKKFMENPCYSFKSM

SEQ ID NO: 51 - protein, 316 aa, Artificial sequence
  synthetic
MAPENFTRVTEFILTGVSSCPELQIPLFLVFLVLYGLTMAGNLGIITLTSVDSRLQTPMYFFLQHLALINLGNSTVIAPKMLINFLVKKKTTSFYECATQLGGFLFFIVSEVIMLALMAYDRYVAICNPLLYMVVVSRRLCLLLVSLTYLYGFSTAIVVSSYVFSVSYCSSNIINHFYCDNVPLLALSCSDTYLPETVVFISAATNVVGSLIIVLVSYFNIVLSILKICSSEGRKKAFSTCASHMMAVTIFYGTLLFMYVQPRSNHSLDTDDKMASVFYTLVIPMLNPLIYSLRNKDVKTALQRFMTNLCYSFKTM

SEQ ID NO: 52 - protein, 307 aa, Artificial sequence
  synthetic
MGQHNLTVLTEFILMELTRRPELQIPLFGVFLVIYLITVVGNLTMIILTKLDSHLHTPMYFSIRHLAFVDLGNSTVICPKVLANFVVDRNTISYYACAAQLAFFLMFIISEFFILSAMAYDRYVAICNPLLYYVIMSQRLCHVLVGIQYLYSTFQALMFTIKIFTLTFCGSNVISHFYCDDVPLLPMLCSNAQEIELLSILFSVFNLISSFLIVLVSYMLILLAICQMHSAEGRKKAFSTCGSHLTVVVVFYGSLLFMYMQPNSTHFFDTDKMASVFYTLVIPMLNPLIYSLRNEEVKNAFYKLFEN

SEQ ID NO: 53 - protein, 312 aa, Artificial sequence
  synthetic
MEQHNLTTVNEFILTGITDIAELQAPLFALFLMIYVISVMGNLGMIVLTKLDSRLQTPMYFFLRHLAFMDLGYSTTVGPKMLVNFVVDKNIISYYFCATQLAFFLVFIGSELFILSAMSYDLYVAICNPLLYTVIMSRRVCQVLVAIPYLYCTFISLLVTIKIFTLSFCGYNVISHFYCDSLPLLPLLCSNTHEIELIILIFAAIDLISSLLIVLLSYLLILVAILRMNSAGRQKAFSTCGAHLTVVIVFYGTLLFMYVQPKSSHSFDTDKVASIFYTLVIPMLNPLIYSLRNKDVKYALRRTWNNLCNIFV

SEQ ID NO: 54 - protein, 319 aa, Artificial sequence
  synthetic
MNHVVKHNHTAVTKVTEFILMGITDNPGLQAPLFGLFLIIYLVTVIGNLGMVILTYLDSKLHTPMYFFLRHLSITDLGYSTVIAPKMLVNFIVHKNTISYNWYATQLAFFEIFIISELFILSAMAYDRYVAICKPLLYVIIMAEKVLWVLVIVPYLYSTFVSLFLTIKLFKLSFCGSNIISYFYCDCIPLMSILCSDTNELELIILIFSGCNLLFSLSIVLISYMFILVAILRMNSRKGRYKAFSTCSSHLTVVIMFYGTLLFIYLQPKSSHTLAIDKMASVFYTLLIPMLNPLIYSLRNKEVKDALKRTLTNRFKIPI

SEQ ID NO: 55 - protein, 312 aa, Artificial sequence
  synthetic
MALGNHSTITEFLLLGLSADPNIRALLFVLFLGIYLLTIMENLMLLLMIRADSCLHKPMYFFLSHLSFVDLCFSSVIVPKMLENLLSQRKTISVEGCLAQVFFVFVTAGTEACLLSGMAYDRHAAICRPLLYGQIMGKQLYMHLVWGSWGLGFLDALINVLLAVNMVFCEAKIIHHYSYEMPSLLPLSCSDISRSLIALLCSTLLHGLGNFLLVFLSYTRIISTILSISSTSGRSKAFSTCSAHLTAVTLYYGSGLLRHLMPNSGSPIELIFSVQYTVVTPMLNSLIYSLKNKEVKVALKRTLEKYLQYTRR

SEQ ID NO: 56 - protein, 310 aa, Artificial sequence
  synthetic
MRENQTLVTEFILLGFSSLPELQALLFLLFLLIYLLTLLGNLLIILVIWVDSHLHTPMYFFLCNLSFSEICYTTVIVPKMLADLLSPDRTISFLGCATQMFFFFFFGSTECFLLTVMAYDRYVAICHPLRYPVIMSPRLCAQLVAGSWASGFLVSLVQTSLIFHLPFCGPNEINHFFCDIPPVLKLACADTTVNEIVIFVVTILVLLGPFLLILLSYVFIVAAILKIPSAEGRRKAFSTCASHLTVVILHYGCASFIYLRPKSNYSPEDKLVSVTYTVLTPLLNPIIYSLRNKEVKNALKRLLGRKLALQ

SEQ ID NO: 57 - protein, 315 aa, Artificial sequence
  synthetic
MLGLNHTSMSEFILVGFSAFPHLQLMLFLLFLLMYLFTLLGNLLIMATVWSERSLHTPMYLFLCVLSVSEILYTVAIIPRMLADLLSTQRSIAFLACASQMFFSFSFGFTHSFLLTVMGYDRYVAICHPLRYNVLMSPRGCACLVGCSWAGGSVMGMVVTSAIFQLTFCGSHEIQHFLCHVPPLLKLACGNNVPAVALGVGLVCIMALLGCFLLILLSYAFIVADILKIPSAEGRNKAFSTCASHLIVVIVHYGFASVIYLKPKGPHSQEGDTLMATTYAVLTPFLSPIIFSLRNKELKVAMKRTFLSTLYSSGT

SEQ ID NO: 58 - protein, 315 aa, Artificial sequence
  synthetic
MQGLNHTSVSEFILVGFSAFPHLQLMLFLLFLLMYLFTLLGNLLIMATVWSERSLHMPMYLFLCALSITEILYTVAIIPRMLADLLSTQRSIAFLACASQMFFSFSFGFTHSFLLTVMGYDRYVAICHPLRYNVLMSLRGCTCRVGCSWAGGLVMGMVVTSAIFHLAFCGHKEIHHFFCHVPPLLKLACGDDVLVVAKGVGLVCITALLGCFLLILLSYAFIVAAILKIPSAEGRNKAFSTCASHLTVVVVHYGFASVIYLKPKGPQSPEGDTLMGITYTVLTPFLSPIIFSLRNKELKVAMKKTCFTKLFPQNC

SEQ ID NO: 59 - protein, 318 aa, Artificial sequence
  synthetic
MQRANHSTVTQFILVGFSVFPHLQLMLFLLFLLMYLFTLLGNLLIMATVWSERSLHTPMYLFLCALSVSEILYTVAIIPRMLADLLSTQRSIAFLACASQMFFSFSFGFTHSFLLTVMGYDRYVAICHPLRYNVLMSPRGCACLVGCSWAGGLVMGMVVTSAIFHLAFCGHKEIHHFACHVPPLLKLACGDDVLVVAKGVGLVCITALLGCFLLILLSYAFIVAAILKIPSAEGRNKAFSTCASHLTVVVVHYGFASVIYLKPKSPQSLEGDTLMGITYTVLTPFLSPIIFSLRNKELKVAMKKTFFSKLYPEKNVMM

SEQ ID NO: 60 - protein, 316 aa, Artificial sequence
  synthetic
MPGQNYRTISEFILSGFSAFPQQLLPVLFLLYLLMFLFTLLGNLLIMATVWIERRLHTPMYLFLCALSISEILFTVAITPRMLADLLFTHRSITFVACAIQMFFSFMFGFTHSFLLMVMGYDHYVTICHPLHYNMLMSPRGCAHLVAWTWAGGSVMGMMVTMMVFHLTFCGSNVIHHFLCHVLSLLKLACGSKTSSVIMGVMLVCVTALIGCLFLIILSFVFIVAAILRIPSAEGRHKTFSTCVSHLTVVVMHYSFASLIYLKPKGLHSMYSDALMATTYTVFTPFLSPIIFSLRNKELKNAINKNFCRRFCPLSS

SEQ ID NO: 61 - protein, 316 aa, Artificial sequence
  synthetic
MPSQNYSIISEFNLFGFSAFPQHLLPILFLLYLLMFLFTLLGNLLIMATIWIEHRLHTPMYLFLCTLSVSEILFTVAITPRMLADLLSTHHSITFVACANQMFFSFMFGFTHSFLLLVMGYDRYVAICHPLRYNVLMSPRDCAHLVACTWAGGSVMGMMVTTIVFHLTFCGSNVIHHFFCHVLSLLKLACENKTSSVIMGVMLVCVTALIGCLFLIILSYVFIVAAILRIPSAEGRHKTFSTCVSHLTVVVTHYSFASFIYLKPKGLHSMYSDALMATTYTVFTPFLSPIIFSLRNKELKNAINKNFYRKFCPPSS

SEQ ID NO: 62 - protein, 317 aa, Artificial sequence
  synthetic
MAIGNWTEISEFILMSFSSLPTEIQSLLFLTFLTIYLVTLKGNSLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLKLVCADTALFEIYAIVGTILVVMIPCLLILCSYTRIAAAILKIPSAKGKHKAFSTCSSHLLVVSLFYISSSLTYFWPKSNNSPESKKLLSLSYTVVTPMLNPIIYSLRNSEVKNALSRTFHKVLALRNCIP

SEQ ID NO: 63 - protein, 303 aa, Artificial sequence
  synthetic
MSFSSLPTEIQSLLFLTFLTIYLVTLMGNCLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLRLVCADTALFEIYAIVGTILVVMIPCLLILCSYTHIAAAILKIPSAKGKNKAFSTCSSHLLVVSLFYISLSLTYFRPKSNNSPEGKKLLSLSYTVMTPMLNPIIYSLRNNEVKNALSRTVSKALALRNCIP

SEQ ID NO: 64 - protein, 324 aa, Artificial sequence [sequence omitted]

SEQ ID NO: 65 - protein, 316 aa, Artificial sequence
  synthetic
MICENHTRVTEFILLGFTNNPEMQVSLFIFFLAIYTVTLLGNFLIVTVTSVDLALQTPMYFFLQNLSLLEVCFTLVMVPKMLVDLVSPRKIISFVGCGTQMYFFFFFGSSECFLLSMMAYDRFVAICNPLHYSVIMNRSLCLWMAIGSWMSGVPVSMLQTAWMMALPFCGPNAVDHFFCDGPPVLKLVTVDTTMYEMQALASTLLFIMFPFCLILVSYTRIIITILRMSSATGRQKAFSTCSSHLIVVSLFYGTASLTYLRPKSNQSPESKKLVSLSYTVITPMLNPIIYGLRNNEVKGAVKRTITQKVLQKLDVF

SEQ ID NO: 66 - protein, 312 aa, Artificial sequence
  synthetic
MERVNETVVREVIFLGFSSLARLQQLLFVIFLLLYLFTLGTNAIIISTIVLDRALHIPMYFFLAILSCSEICYTFIIVPKMLVDLLSQKKTISFLGCAIQMFSFLFLGCSHSFLLAVMGYDRYIAICNPLRYSVLMGHGVCMGLVAAACACGFTVAQIITSLVFHLPFYSSNQLHHFFCDIAPVLKLASHHNHFSQIVIFMLCTLVLAIPLLLILVSYVHILSAILQFPSTLGRCKAFSTCVSHLIIVTVHYGCASFIYLRPQSNYSSSQDALISVSYTIITPLFNPMIYSLRNKEFKSALCKIVRRTISLL

SEQ ID NO: 67 - protein, 313 aa, Artificial sequence
  synthetic
MEQVNKTVVREFVVLGFSSLARLQQLLFVIFLLLYLFTLGTNAIIISTIVLDRALHTPMYFFLAILSCSEICYTFVIVPKMLVDLLSQKKTISFLGCAIQMFSFLFFGSSHSFLLAAMGYDRYMAICNPLRYSVLMGHGVCMGLMAAACACGFTVSLVTTSLVFHLPFHSSNQLHHFFCDISPVLKLASQHSGFSQLVIFMLGVFALVIPLLLILVSYIRIISAILKIPSSVGRYKTFSTCASHLIVVTVHYSCASFIYLRPKTNYTSSQDTLISVSYTILTPLFNPMIYSLRNKEFKSALRRTIGQTFYPLS

SEQ ID NO: 68 - protein, 314 aa, Artificial sequence
  synthetic
MRGFNKTTVVTQFILVGFSSLGELQLLLFVIFLLLYLTILVANVTIMAVIRFSWTLHTPMYGFLFILSFSESCYTFVIIPQLLVHLLSDTKTISFMACATQLFFFLGFACTNCLLIAVMGYDRYVAICHPLRYTLIINKRLGLELISLSGATGFFIALVATNLICDMRFCGPNRVNHYFCDMAPVIKLACTDTHVKELALFSLSILVIMVPFLLILISYGFIVNTILKIPSAEGKKAFVTCASHLTVVFVHYGCASIIYLRPKSKSASDKDQLVAVTYTVVTPLLNPLVYSLRNKEVKTALKRVLGMPVATKMS

SEQ ID NO: 69 - protein, 324 aa, Artificial sequence
  synthetic
MFYFFPPLQILAENLTMVTEFLLLGFSSLGEIQLALFVVFLFLYLVILSGNVTIISVIHLDKSLHTPMYFFLGILSTSETFYTFVILPKMLINLLSVARTISFNCCALQMFFFLGFAITNCLLLGVMGYDRYAAICHPLHYPTLMSWQVCGKLAAACAIGGFLASLTVVNLVFSLPFCSANKVNHYFCDISAVILLACTNTDVNEFVIFICGVLVLVVPFLFICVSYLCILRTILKIPSAEGRRKAFSTCASHLSVVIVHYGCASFIYLRPTANYVSNKDRLVTVTYTIVTPLLNPMVYSLRNKDVQLAIRKVLGKKGSLKLYN

SEQ ID NO: 70 - protein, 329 aa, Artificial sequence
  synthetic
MPKLNSTFVTEFLFEGFSSFRRQHKLVFFVVFLTLYLLTLSGNVIIMTIIRLDHHLHTPMYFFLCMLSISETCYTVAIIPHMLSGLLNPHQPIATQSCATQLFFYLTFGINNCFLLTVMGYDRYVAICNPLRYSVIMGKRACIQLASGSLGIGLGMAIVQVTSVFGLPFCDAFVISHFFCDVRHLLKLACTDTTVNEIINFVVSVCVLVLPMGLVFISYVLIISTILKIASAEGQKKAFATCASHLTVVIIHYGCASIIYLKPKSQSSLGQDRLISVTYTHHSPTEPCCVQPEEQGGQRCSAQSRGAKNSVSLMKRGCEGFSFAFINMY

SEQ ID NO: 71 - protein, 309 aa, Artificial sequence
  synthetic
MKRENFTLITDFVFQGFSSFHEQQITLFGVFLALYILTLAGNIIIVTIIRMDLHLHTPMYFFLSMLSTSETVYTLVILPRMLSSLVGMSQPISLAGCATQMFFFVTFGITNCFLLTAMGYDRYVAICNPLRYMVIMNKRLRIQLVLGACSIGLIVAITQVTSVFRLPFCARKVPHFFCDIRPVMKLSCIDTTVNEILTLIISVLVLVVPMGLVFISYVLIISTILKIASVEGRKKAFATCASHLTVVIVHYSCASIAYLKPKSENTREHDQLISVTYTVITPLLNPVVYTLRNKEVKDALCRAVGGKFS

SEQ ID NO: 72 - protein, 309 aa, Artificial sequence
  synthetic
MKRKNFTEVSEFIFLGFSSFGKHQITLFVVFLTVYILTLVANIIIVTIICIDHHLHTPMYFFLSMLASSETVYTLVIVPRMLLSLIFHNQPISLAGCATQMFFFVILATNNCFLLTAMGYDRYVAICRPLRYTVIMSKGLCAQLVCGSFGIGLTMAVLHVTAMFNLPFCGTVVDHFFCDIYPVMKLSCIDTTINEIINYGVSSFVIFVPIGLIFISYVLVISSILQIASAEGRKKTFATCVSHLTVVIVHCGCASIAYLKPKSESSIEKDLVLSVTYTIITPLLNPVVYSLRNKEVKDALCRVVGRNIS

SEQ ID NO: 73 - protein, 314 aa, Artificial sequence
  synthetic
MERQNQSCVVEFILLGFSNYPELQGQLFVAFLVIYLVTLIGNAIIIVIVSLDQSLHVPMYLFLLNLSVVDLSFSAVIMPEMLVVLSTEKTTISFGGCFAQMYFILLFGGAECFLLGAMAYDRFAAICHPLNYQMIMNKGVFMKLIIFSWALGFMLGTVQTSWVSSFPFCGLNEINHISCETPAVLELACADTFLFEIYAFTGTFLIILVPFLLILLSYIRVLFAILKMPSTTGRQKAFSTCAAHLTSVTLFYGTASMTYLQPKSGYSPETKKVMSLSYSLLTPLLNLLIYSLRNSEMKRALMKLWRRRVVLHTI

SEQ ID NO: 74 - protein, 314 aa, Artificial sequence
  synthetic
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 75 - protein, 313 aa, Artificial sequence
  synthetic
MGQTNVTSWRDFVFLGFSSSGELQLLLFALFLSLYLVTLTSNVFIIIAIRLDSHLHTPMYLFLSFLSFSETCYTLGIIPRMLSGLAGGDQAISYVGCAAQMFFSASWACTNCFLLAAMGFDRYVAICAPLHYASHMNPTLCAQLVITSFLTGYLFGLGMTLVIFHLSFCSSHEIQHFFCDTPPVLSLACGDTGPSELRIFILSLLVLLVSFFFITISYAYILAAILRIPSAEGQKKAFSTCASHLTVVIIHYGCASFVYLRPKASYSLERDQLIAMTYTVVTPLLNPIVYSLRNRAIQTALRNAFRGRLLGKG

SEQ ID NO: 76 - protein, 312 aa, Artificial sequence
  synthetic
MSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 77 - protein, 309 aa, Artificial sequence
  synthetic
MKINQTILKEFILVGFSVYPHVQTFLFVVFFCLYLLTLAGNLIIMGLTWVDRSLHTPMYLFLSALSFSETCYTLTIVPKMLEDLLAKDRSISVTGCSLQMCFFLGLGGTNCIILTLMGYDRFLAICNPLRYPLLMTNIVCGQLVASACTAGFFISLTETALIFRDSFCRPNLVKHFFCHMLAVIRLSCIDSNHTEFIITLISVSGLLGTLLLIILTDVFIISTVLRIPSAEGKQKAFTTCASHLTVVIIHFGFASIVYLKPEASGDDTLIAVPYTVITPFLSPIIFSLRNKDMKNAFRRMMGNTVALKK

SEQ ID NO: 78 - protein, 319 aa, Artificial sequence
  synthetic
MPVGKLVFNQSEPTEFVFRAFTTATEFQVLLFLLFLLLYLMILCGNTAIIWVVCTHSTLRTPMYFFLSNLSFLELCYTTVVVPLMLSNILGAQKPISLAGCGAQMFFFVTLGSTDCFLLAIMAYDRYVAICHPLHYTLIMTRELCTQMLGGALGLALFPSLQLTALIFTLPFCGHHQEINHFLCDVPPVLRLACADIRVHQAVLYVVSILVLTIPFLLICVSYVFITCAILSIRSAEGRRRAFSTCSFHLTVVLLQYGCCSLVYLRPRSSTSEDEDSQIALVYTFVTPLLNPLLYSLRNKDVKGALRSAIIRKAASDAN

SEQ ID NO: 79 - protein, 309 aa, Artificial sequence
  synthetic
MEGINKTAKMQFFFRPFSPDPEVQMLIFVVFLMMYLTSLGGNATIAVIVQINHSLHTPMYFFLANLAVLEIFYTSSITPLALANLLSMGKTPVSITGCGTQMFFFVFLGGADCVLLVVMAYDQFIAICHPLRYRLIMSWSLCVELLVGSLVLGFLLSLPLTILIFHLPFCHNDEIYHFYCDMPAVMRLACADTRVHKTALYIISFIVLSIPLSLISISYVFIVVAILRIRSAEGRQQAYSTCSSHILVVLLQYGCTSFIYLSPSSSYSPEMGRVVSVAYTFITPILNPLIYSLRNKELKDALRKALRKF

SEQ ID NO: 80 - protein, 305 aa, Artificial sequence
  synthetic
MEFVFLAYPSCPELHILSFLGVSLVYGLIITGNILIVVSIHTETCLCTSMYYFLGSLSGIEICYTAVVVPHILANTLQSEKTITLLGCATQMAFFIALGSADCFLLAAMAYDRYVAICHPLQYPLLMTLTLCVHLVVASVISGLFLSLQLVAFIFSLPFCQAQGIEHFFCDVPPVMHVVCAQSHIHEQSVLVAAILAIAVPFFLITTSYTFIVAALLKIHSAAGRHRAFSTCSSHLTVVLLQYGCCAFMYLCPSSSYNPKQDRFISLVYTLGTPLLNPLIYALRNSEMKGAVGRVLTRNCLSQNS

SEQ ID NO: 81 - protein, 301 aa, Artificial sequence
  synthetic
MEFVLLGFSDIPNLHWMLFSIFLLMYLMILMCNGIIILLIKIHPALQTPMYFFLSNFSLLEICYVTIIIPRMLMDIWTQKGNISLFACATQMCFFLMLGGTECLLLTVMAYDRYVAICKPLQYPLVMNHKVCIQLIIASWTITIPVVIGETCQIFLLPFCGTNTINHFFCDIPPILKLACGNIFVNEITVHVVAVVFITVPFLLIVVSYGKIISNILKLSSARGKAKAFSTCSSHLIVVILFFGAGTITYLQPKPHQFQRMGKLISLFYTILIPTLNPIIYTLRNKDIMVALRKLLAKLLT

SEQ ID NO: 82 - protein, 320 aa, Artificial sequence
  synthetic
MTTENPNQTVVSHFFLEGLRYTAKHSSLFFLLFLLIYSITVAGNLLILLTVGSDSHLSLPMYHFLGHLSFLDACLSTVTVPKVMAGLLTLDGKVISFEGCAVQLYCFHFLASTECFLYTVMAYDRYLAICQPLHYPVAMNRRMCAEMAGITWAIGATHAAIHTSLTFRLLYCGPCHIAYFFCDIPPVLKLACTDTTINELVMLASIGIVAAGCLILIVISYIFIVAAVLRIRTAQGRQRAFSPCTAQLTGVLLYYVPPVCIYLQPRSSEAGAGAPAVFYTIVTPMLNPFIYTLRNKEVKHALQRLLCSSFRESTAGSPPP

SEQ ID NO: 83 - protein, 332 aa, Artificial sequence
  synthetic
MLEGVEHLLLLLLLTDVNSKELQSGNQTSVSHFILVGLHHPPQLGAPLFLAFLVIYLLTVSGNGLIILTVLVDIRLHRPMCLFLCHLSFLDMTISCAIVPKMLAGFLLGSRIISFGGCVIQLFSFHFLGCTECFLYTLMAYDRFLAICKPLHYATIMTHRVCNSLALGTWLGGTIHSLFQTSFVFRLPFCGPNRVDYIFCDIPAMLRLACADTAINELVTFADIGFLALTCFMLILTSYGYIVAAILRIPSADGRRNAFSTCAAHLTVVIVYYVPCTFIYLRPCSQEPLDGVVAVFYTVITPLLNSIIYTLCNKEMKAALQRLGGHKEVQPH

SEQ ID NO: 84 - protein, 311 aa, Artificial sequence
  synthetic
MSNASLVTAFILTGLPHAPGLDALLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATGTWLSGSLHSAVQTILTFHLPYCGPNQIQHYFCDAPPILKLACADTSANVMVIFVDIGIVASGCFVLIVLSYVSIVCSILRIRTSDGRRRAFQTCASHCIVVLCFFVPCVVIYLRPGSMDAMDGVVAIFYTVLTPLLNPVVYTLRNKEVKKAVLKLRDKVAHPQRK

SEQ ID NO: 85 - protein, 311 aa, Artificial sequence
  synthetic
MSKTSLVTAFILTGLPHAPGLDAPLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATSTWLSGSLHSAVQTILTFHLPYCGPNQIQHYLCDAPPILKLACADTSANEMVIFVDIGLVASGCFLLIVLSYVSIVCSILRIHTSEGRHRAFQTCASHCIVVLCFFVPCVFIYLRPGSRDVVDGVVAIFYTVLTPLLNPVVYTLRNKEVKKAVLKLRDKVAHSQGE

SEQ ID NO: 86 - protein, 311 aa, Artificial sequence
  synthetic
MSNATLLTAFILTGLPHAPGLDAPLFGIFLVVYVLTVLGNLLILLVIRVDSHLHTPMYYFLTNLSFIDMWFSTVTVPKMLMTLVSPSGRTISFHSCVAQLYFFHFLGSTECFLYTVMSYDRYLAISYPLRYTNMMTGRSCALLATGTWLSGSLHSAVQTILTFHLPYCGPNQIQHYFCDAPPILKLACADTSANEMVIFVNIGLVASGCFVLIVLSYVSIVCSILRIRTSEGRHRAFQTCASHCIVVLCFFGPGLFIYLRPGSRDALHGVVAVFYTTLTPLFNPVVYTLRNKEVKKALLKLKNGSVFAQGE

SEQ ID NO: 87 - protein, 311 aa, Artificial sequence
  synthetic
MSNASLLTAFILMGLPHAPALDAPLFGVFLVVYVLTVLGNLLILLVIRVDSHLHTTMYYFLTNLSFIDMWFSTVTVPKLLMTLVFPSGRAISFHSCMAQLYFFHFLGGTECFLYRVMSCDRYLAISYPLRYTSMMTGRSCTLLATSTWLSGSLHSAVQAILTFHLPYCGPNWIQHYLCDAPPILKLACADTSAIETVIFVTVGIVASGCFVLIVLSYVSIVCSILRIRTSEGKHRAFQTCASHCIVVLCFFGPGLFIYLRPGSRKAVDGVVAVFYTVLTPLLNPVVYTLRNKEVKKALLKLKDKVAHSQSK

SEQ ID NO: 88 - protein, 313 aa, Artificial sequence
  synthetic
MERINSTLLTAFILTGIPYPLRLRTLFFVFFFLIYILTQLGNLLILITVWADPRLHARPMYIFLGVLSVIDMSISSIIVPRLMMNFTLGVKPIPFGGCVAQLYFYHFLGSTQCFLYTLMAYDRYLAICQPLRYPVLMTAKLSALLVAGAWMAGSIHGALQAILTFRLPYCGPNQVDYFFCDIPAVLRLACADTTVNELVTFVDIGVVVASCFSLILLSYIQIIQAILRIHTADGRRRAFSTCGAHVTVVTVYYVPCAFIYLRPETNSPLDGAAALVPTAITPFLNPLIYTLRNQEVKLALKRMLRSPRTPSEV

SEQ ID NO: 89 - protein, 310 aa, Artificial sequence
  synthetic
MGKTKNTSLDAVVTDFILLGLSHPPNLRSLLFLVFFIIYILTQLGNLLILLTMWADPKLCARPMYILLGVLSFLDMWLSSVTVPRLILDFTPSIKAIPFGGCVAQLYFFHFLGSTQCFLYTLMAYDRYLAICQPLHYPVLMNGRLCTVLVAGAWVAGSMHGSIQATLTFRLPYCGPNQVDYFICDIRAVLRLACADTTVNELVTFVDVRVVAASCFMLILLSYANIVHAILKIRTADGRRRAFSTCGSHLIVVTVYYVPCIFIYLRAGSKDPLDGAAAVFYTVVTPLLNPLIYTLRNQEVKSALKRITAG

SEQ ID NO: 90 - protein, 312 aa, Artificial sequence
  synthetic
MEVKNCCMVTEFILLGIPHTEGLEMTLFVLFLPFYACTLLGNVSILVAVMSSARLHTPMYFFLGNLSVFDMGFSSVTCPKMLLYLMGLSRLISYKDCVCQLFFFHFLGSIECFLFTVMAYDRFTAICYPLRYTVIMNPRICVALAVGTWLLGCIHSSILTSLTFTLPYCGPNEVDHFFCDIPALLPLACADTSLAQRVSFTNVGLISLVCFLLILLSYTRITISILSIRTTEGRRRAFSTCSAHLIAILCAYGPIITVYLQPTPNPMLGTVVQILMNLVGPMLNPLIYTLRNKEVKTALKTILHRTGHVPES

SEQ ID NO: 91 - protein, 313 aa, Artificial sequence
  synthetic
MAGENHTTLPEFLLLGFSDLKALQGPLFWVVLLVYLVTLLGNSLIILLTQVSPALHSPMYFFLRQLSVVELFYTTDIVPRTLANLGSPHPQAISFQGCAAQMYVFIVLGISECCLLTAMAYDRYVAICQPLRYSTLLSPRACMAMVGTSWLTGIITATTHASLIFSLPFRSHPIIPHFLCDILPVLRLASAGKHRSEISVMTATIVFIMIPFSLIVTSYIRILGAILAMASTQSRRKVFSTCSSHLLVVSLFFGTASITYIRPQAGSSVTTDRVLSLFYTVITPMLNPIIYTLRNKDVRRALRHLVKRQRPSP

SEQ ID NO: 92 - protein, 317 aa, Artificial sequence
  synthetic
MLRNGSIVTEFILVGFQQSSTSTRALLFALFLALYSLTMAMNGLIIFITSWTDPKLNSPMYFFLGHLSLLDVCFITTTIPQMLIHLVVRDHIVSFVCCMTQMYFVFCVGVAECILLAFMAYDRYVAICYPLNYVPIISQKVCVRLVGTAWFFGLINGIFLEYISFREPFRRDNHIESFFCEAPIVIGLSCGDPQFSLWAIFADAIVVILSPMVLTVTSYVHILATILSKASSSGRGKTFSTCASHLTVVIFLYTSAMFSYMNPHSTHGPDKDKPFSLLYTIITPMCNPIIYSFRNKEIKEAMVRALGRTRLAQPQSV

SEQ ID NO: 93 - protein, 313 aa, Artificial sequence
  synthetic
MSINNSTSSAATFLLTGIPGLEAAHIWISIPFCFMYLIAILGNGTILFIIRTEPSLHEPMYYFLSMLAATDLGLSLSTLPTVLGIFWFNAREISFNACFAQMFFIHGFSFMESSVLLAMAFDRFVAICNPLRYASILTNTRVAKIGLAILTRSFLLILPLPFLLKRLPYCHSNVLSHSYCLHQDVMKLACADIRFNSIYGLFVVLSTMGLDSLLILFSYILILKTVLGIASREERLKALNTCVSHICAVLVFYVPMIGLSLVHRFGKHVPPVVHVLMANVYLLVPPVMNPIIYSVKTKQIRKRILRLFSLKKI

SEQ ID NO: 94 - protein, 314 aa, Artificial sequence
  synthetic
MTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 95 - protein, 321 aa, Artificial sequence
  synthetic
MTILLNSSLQRATFFLTGFQGLEGLHGWISIPFCFIYLTVILGNLTILHVICTDATLHGPMYYFLGMLAVTDLGLCLSTLPTVLGIFWFDTREIGIPACFTQLFFIHTLSSMESSVLLSMSIDRYVAVCNPLHDSTVLTPACIVKMGLSSVLRSALLILPLPFLLKRFQYCHSHVLAHAYCLHLEIMKLACSSIIVNHIYGLFVVACTVGVDSLLIFLSYALILRTVLSIASHQERLRALNTCVSHICAVLLFYIPMIGLSLVHRFGEHLPRVVHLFMSYVYLLVPPLMNPIIYSIKTKQIRQRIIKKFQFIKSLRCFWKD

SEQ ID NO: 96 - protein, 312 aa, Artificial sequence
  synthetic
MSVLNNSEVKLFLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGKLLNVCGR

SEQ ID NO: 97 - protein, 313 aa, Artificial sequence
  synthetic
MSIINTSYVEITTFFLVGMPGLEYAHIWISIPICSMYLIAILGNGTILFIIKTEPSLHEPMYYFLSMLAMSDLGLSLSSLPTVLSIFLFNAPEISSNACFAQEFFIHGFSVLESSVLLIMSFDRFLAIHNPLRYTSILTTVRVAQIGIVFSFKSMLLVLPFPFTLRNLRYCKKNQLSHSYCLHQDVMKLACSDNRIDVIYGFFGALCLMVDFILIAVSYTLILKTVLGIASKKEQLKALNTCVSHICAVIIFYLPIINLAVVHRFARHVSPLINVLMANVLLLVPPLTNPIVYCVKTKQIRVRVVAKLCQRKI

SEQ ID NO: 98 - protein, 313 aa, Artificial sequence
  synthetic
MSIINTSYVEITTFFLVGMPGLEYAHIWISIPICSMYLIAILGNGTILFIIKTEPSLHGPMYYFLSMLAMSDLGLSLSSLPTVLSIFLFNAPETSSSACFAQEFFIHGFSVLESSVLLIMSFDRFLAIHNPLRYTSILTTVRVAQIGIVFSFKSMLLVLPFPFTLRSLRYCKKNQLSHSYCLHQDVMKLACSDNRIDVIYGFFGALCLMVDFILIAVSYTLILKTVPGIASKKEELKALNTCVSHICAVIIFYLPIINLAVVHRFAGHVSPLINVLMANVLLLVPPLMKPIVYCVKTKQIRVRVVAKLCQWKI

SEQ ID NO: 99 - protein, 315 aa, Artificial sequence
  synthetic
MGDWNNSDAVEPIFILRGFPGLEYVHSWLSILFCLAYLVAFMGNVTILSVIWIESSLHQPMYYFISILAVNDLGMSLSTLPTMLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLGVDSIFILLSYVLILNTVLDIASREEQLKALNTCVSHICVVLIFFVPVIGVSMVHRFGKHLSPIVHILMADIYLLLPPVLNPIVYSVRTKQIRLGILHKFVLRRRF

SEQ ID NO: 100 - protein, 312 aa, Artificial sequence
  synthetic
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 101 - protein, 314 aa, Artificial sequence
  synthetic
MLGLNGTPFQPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 102 - protein, 312 aa, Artificial sequence
  synthetic
MEILSNSTSKFPTFLLTGIPGLESAHVWISIPFCCFYAIALSGNSVILFVIITQQSLHEPMYYFLFRLSATDLGLTVSSLSTTLGILWFEAREISLYSCIVQMFFLHGFTFMESGVLVATAFDRYVAICDPLRYTTILTNSRIIQMGLLMITRAIVLILPLLLLLKPLYFCRMNALSHSYCYHPDVIQLACSDIRANSICGLIDLILTTGIDTPCIVLSYILIIHSVLRIASPEEWHKVFSTCVSHVGAVAFFYIHMLSLSLVYRYGRSAPRVVHSVMANVYLLLPPVLNPIIDSVKTKQIRKAMLSLLLTK

SEQ ID NO: 103 - protein, 330 aa, Artificial sequence
  synthetic
MSVLNNTIAEPLIFLLMGIPGLKATQYWISIPFCLLYVVAVSGNSMILFVVLCERSLHKPMYYFLSMLSATDLSLSLCTLSTTLGVFWFEAREINLNACIAQMFFLHGFTFMESGVLLAMAFDRFVAICYPLRYTTILTNARIAKIGMSMLIRNVAVMLPVMLFVKRLSFCSSMVLSHSYCYHVDLIQLSCTDNRINSILGLFALLSTTGFDCPCILLSYILIIRSVLSIASSEERRKAFNTCTSHISAVSIFYLPLISLSLVHRYGHSAPPFVHIIMANVFLLIPPVLNPIIYSVKIKQIQKAIIKVLIQKHSKSNHQLFLIRDKAIYE

SEQ ID NO: 104 - protein, 315 aa, Artificial sequence
  synthetic
MITSVSPSTSTNSSFLLTGFSGMEQQYPWLSIPFSSIYAMVLLGNCMVLHVIWTEPSLHQPMFYFLSMLALTDLCMGLSTVYTVLGILWGIIREISLDSCIAQSYFIHGLSFMESSVLLTMAFDRYIAICNPLRYSSILTNSRIIKIGLTIIGRSFFFITPPIICLKFFNYCHFHILSHSFCLHQDLLRLACSDIRFNSYYALMLVICILLLDAILILFSYILILKSVLAVASQEERHKLFQTCISHICAVLVFYIPIISLTMVHRFGKHLSPVAHVLIGNIYILFPPLMNPIIYSVKTQQIHTRMLRLFSLKRY

SEQ ID NO: 105 - protein, 317 aa, Artificial sequence
  synthetic
MSQVTNTTQEGIYFILTDIPGFEASHIWISIPVCCLYTISIMGNTTILTVIRTEPSVHQRMYLFLSMLALTDLGLTLTTLPTVMQLLWFNVRRISSEACFAQFFFLHGFSFMESSVLLAMSVDCYVAICCPLHYASILTNEVIGRTGLAIICCCVLAVLPSLFLLKRLPFCHSHLLSRSYCLHQDMIRLVCADIRLNSWYGFALALLIIIVDPLLIVISYTLILKNILGTATWAERLRALNNCLSHILAVLVLYIPMVGVSMTHRFAKHASPLVHVIMANIYLLAPPVMNPIIYSVKNKQIQWGMLNFLSLKNMHSR

SEQ ID NO: 106 - protein, 318 aa, Artificial sequence
  synthetic
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 107 - protein, 320 aa, Artificial sequence
  synthetic
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 108 - protein, 310 aa, Artificial sequence
  synthetic
MWYNNSAGPFLLTGFLGSEAVHYRISMSFFVIYFSVLFGNGTLLVLIWNDHSLHEPMYYFLAMLADTDLGMTFTTMPTVLGVLLLDQREIAHAACFTQSFIHSLAIVESGILLVLAYDCFIAIRTPLRYNCILTNSRVMNIGLGVLMRGFMSILPIILSLYCYPYCGSRALLHTFCLHQDVIKLACADITFNHIYPIIQTSLTVFLDALIIIFSYILILKTVMGIASGQEEAKSLNTCVSHISCVLVFHITVMGLSFIHRFGKHAPHVVPITMSYVHFLFPPFVNPIIYSIKTKQIQRSIIRLFSGQSRA

SEQ ID NO: 109 - protein, 312 aa, Artificial sequence
  synthetic
MWPNITAAPFLLTGFPGLEAAHHWISIPFFAVYVCILLGNGMLLYLIKHDHSLHEPMYYFLTMLAGTDLMVTLTTMPTVMGILWVNHREISSVGCFLQAYFIHSLSVVESGSLLAMAYDCFIAIRNPLRYASILTNTRVIALGVGVFLRGFVSILPVILRLFSFSYCKSHVITRAFCLHQEIMRLACADITFNRLYPVILISLTIFLDCLIILFSYILILNTVIGIASGEERAKALNTCISHISCVLIFYVTVMGLTFIYRFGKNVPEVVHIIMSYIYFLFPPLMNPVIYSIKTKQIQYGIIRLLSKHRFSS

SEQ ID NO: 110 - protein, 312 aa, Artificial sequence
  synthetic
MSSSGSSHPFLLTGFPGLEEAHHWISVFFLFMYISILFGNGTLLLLIKEDHNLHEPMYFFLAMLAATDLGLALTTMPTVLGVLWLDHREIGSAACFSQAYFIHSLSFLESGILLAMAYDRFIAICNPLRYTSVLTNTRVVKIGLGVLMRGFVSVVPPIRPLYFFLYCHSHVLSHAFCLHQDVIKLACADTTFNRLYPAVLVVFIFVLDYLIIFISYVLILKTVLSIASREERAKALITCVSHICCVLVFYVTVIGLSLIHRFGKQVPHIVHLIMSYAYFLFPPLMNPITYSVKTKQIQNAILHLFTTHRIGT

SEQ ID NO: 111 - protein, 312 aa, Artificial sequence
  synthetic
MGLNKSASTFQLTGFPGMEKAHHWIFIPLLAAYISILLGNGTLLFLIRNDHNLHEPMYYFLAMLAATDLGVTLTTMPTVLGVLWLDHREIGHGACFSQAYFIHTLSVMESGVLLAMAYDCFITIRSPLRYTSILTNTQVMKIGVRVLTRAGLSIMPIVVRLHWFPYCRSHVLSHAFCLHQDVIKLACADITFNRLYPVVVLFAMVLLDFLIIFFSYILILKTVMGIGSGGERAKALNTCVSHICCILVFYVTVVCLTFIHRFGKHVPHVVHITMSYIHFLFPPFMNPFIYSIKTKQIQSGILRLFSLPHSRA

SEQ ID NO: 112 - protein, 315 aa, Artificial sequence
  synthetic
MLLSNITQFSPIFYLTSFPGLEGIKHWIFIPFFFMYMVAISGNCFILIIIKTNPRLHTPMYYLLSLLALTDLGLCVSTLPTTMGIFWFNSHSIYFGACQIQMFCIHSFSFMESSVLLMMSFDRLVAICHPLRYSVIITGQQVVRAGLIVIFRGPVATIPIVLLLKAFPYCGSVVLSHSFCLHQEVIQLACTDITFNNLYGLMVVVFTVMLDLVLIALSYGLILHTVAGLASQEEQRRAFQTCTAPLCAVLVFFVPMMGLSLVHRFGKHAPPAIHLLMANVYLFVPPMLNPIIYSIKTKEIHRAIIKFLGLKKASK

SEQ ID NO: 113 - protein, 324 aa, Artificial sequence
  synthetic
MQKPQLLVPIIATSNGNLVHAAYFLLVGIPGLGPTIHFWLAFPLCFMYALATLGNLTIVLIIRVERRLHEPMYLFLAMLSTIDLVLSSITMPKMASLFLMGIQEIEFNICLAQMFLIHALSAVESAVLLAMAFDRFVAICHPLRHASVLTGCTVAKIGLSALTRGFVFFFPLPFILKWLSYCQTHTVTHSFCLHQDIMKLSCTDTRVNVVYGLFIILSVMGVDSLFIGFSYILILWAVLELSSRRAALKAFNTCISHLCAVLVFYVPLIGLSVVHRLGGPTSLLHVVMANTYLLLPPVVNPLVYGAKTKEICSRVLCMFSQGGK

SEQ ID NO: 114 - protein, 327 aa, Artificial sequence
  synthetic
MAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 115 - protein, 308 aa, Artificial sequence [sequence omitted]

SEQ ID NO: 116 - protein, 316 aa, Artificial sequence
  synthetic
MKISNNSLGFLPTTFILVGIPGLESEHLWISVPFSLIYIIIFLGNGIILHVIRTDIALHQPMYLFLAMLALAEVRVSASTLPTVLGIFLFGNTEISLEACLFPDVLHPFFIHDGASCAAGHVFGPLYSHLQPTELHSYPDTAQGLWHRSYYRTEKHYAHGSVAHSLMASALLWPQCPLTFLLSAPQSYLSCGNISVNNIYGIFIVTSTFGLDSLLIVISYGLILHTVLGIATGEGRKKALNTCGSHVCAVLAYYVPMIGLSIVHRLGHRVSPLLQAMMANAYLFFPPVVNPIVYSIKTKEIHGAIVRMLLEKRRRV

SEQ ID NO: 117 - protein, 313 aa, Artificial sequence
  synthetic
MPTSNHTSFHPSSFLLVGIPGLESVHIWISIPFCAMYLIALLGNSTLLFVIKTERSLHEPMYYFLAMLAATDLVLSTSTIPKMLAIFWFNLKEISFDACLTQMFFIHSFTGMESGVLLAMAFDRYVAICYPLRYTTILTNKVIGKIGMAVVLRAVLLVIPFPFLLKRLPFCGTNIIPHTYCEHMGVAKLACADIKVNIIYGLFVALLIVGLDVILIALSYVLILRAVFRLPSQDARLKALSTCGSHICVILAFYTPAFFSFLTHRFGHHIPPYIHILLANLYLLVPPMLNPIIYGVKTKQIRERVLKIFFKKK

SEQ ID NO: 118 - protein, 313 aa, Artificial sequence
  synthetic
MPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 119 - protein, 313 aa, Artificial sequence
  synthetic
MSTSNHTQFHPSSFLLLGIPGLEDVHIWIGVPFFFVYLVALLGNTALLFVIQTEQSLHEPMYYFLAMLDSIDLGLSTATIPKMLGIFWFNTKEISFGGCLSHMFFIHFFTAMESIVLVAMAFDRYIAICKPLRYTMILTSKIISLIAGIAVLRSLYMVVPLVFLLLRLPFCGHRIIPHTYCEHMGIARLACASIKVNIRFGLGNISLLLLDVILIILSYVRILYAVFCLPSWEARLKALNTCGSHIGVILAFFTPAFFSFLTHRFGHNIPQYIHIILANLYVVVPPALNPVIYGVRTKQIRERVLRIFLKTNH

SEQ ID NO: 120 - protein, 312 aa, Artificial sequence
  synthetic
MPSINDTHFYPPFFLLLGIPGLDTLHIWISFPFCIVYLIAIVGNMTILFVIKTEHSLHQPMFYFLAMLSMIDLGLSTSTIPKMLGIFWFNLQEISFGGCLLQMFFIHMFTGMETVLLVVMAYDRFVAICNPLQYTMILTNKTISILASVVVGRNLVLVTPFVFLILRLPFCGHNIVPHTYCEHRGLAGLACAPIKINIIYGLMVISYIIVDVILIASSYVLILRAVFRLPSQDVRLKAFNTCGSHVCVMLCFYTPAFFSFMTHRFGQNIPHYIHILLANLYVVVPPALNPVIYGVRTKQIREQIVKIFVQKE

SEQ ID NO: 121 - protein, 325 aa, Artificial sequence
  synthetic
MFLPNDTQFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEARLKSLSTCGSHVCVILAFYTPALFSFMTHRFGRNVPRYIHILLANLYVVVPPMLNPVIYGVRTKQIYKCVKKILLQEQGMEKEEYLIHTRF

SEQ ID NO: 122 - protein, 327 aa, Artificial sequence
  synthetic
MLHTNNTQFHPSTFLVVGVPGLEDVHVWIGFPFFAVYLTALLGNIIILFVIQTEQSLHQPMFYFLAMLAGTDLGLSTATIPKMLGIFWFNLGEIAFGACITQMYTIHICTGLESVVLTVTGIDRYIAICNPLRYSMILTNKVIAILGIVIIVRTLVFVTPFTFLILRLPFCGVRIIPHTYCEHMGLAKLACASINVIYGLIAFSVGYIDISVIGFSYVQILRAVFHLPAWDARPKALSTCGSHVCVMLAFYLPALFSFMTHRFGHNIPHYIHILLANLYVVFPPALNSVIYGVKTKQIREQVLRILNPKSFWHFDPKRIFHNNSVRQ

SEQ ID NO: 123 - protein, 311 aa, Artificial sequence
  synthetic
MFYHNKSIFHPVTFFLIGIPGLEDFHMWISGPFCSVYLVALLGNATILLVIKVEQTLREPMFYFLAILSTIDLALSTTSVPRMLGIFWFDAHEINYGACVAQMFLIHAFTGMEAEVLLAMAFDRYVAVCAPLHYATILTSQVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGVRTKQIRERVLYVFTKK

SEQ ID NO: 124 - protein, 323 aa, Artificial sequence
  synthetic
MSHTNVTIFHPAVFVLPGIPGLEAYHIWLSIPLCLIYITAVLGNSILIVVIVMERNLHVPMYFFLSMLAVMDILLSTTTVPKALAIFWLQAHNIAFDACVTQGFFVHMMFVGESAILLAMAFDRFVAICAPLRYTTVLTWPVVGRIALAVITRSFCIIFPVIFLLKRLPFCLTNIVPHSYCEHIGVARLACADITVNIWYGFSVPIVMVILDVILIAVSYSLILRAVFRLPSQDARHKALSTCGSHLCVILMFYVPSFFTLLTHHFGRNIPQHVHILLANLYVAVPPMLNPIVYGVKTKQIREGVAHRFFDIKTWCCTSPLGS

SEQ ID NO: 125 - protein, 318 aa, Artificial sequence
  synthetic
MSDSNLSDNHLPDTFFLTGIPGLEAAHFWIAIPFCAMYLVALVGNAALILVIAMDNALHAPMYLFLCLLSLTDLALSSTTVPKMLAILWLHAGEISFGGCLAQMFCVHSIYALESSILLAMAFDRYVAICNPLRYTTILNHAVIGRIGFVGLFRSVAIVSPFIFLLRRLPYCGHRVMTHTYCEHMGIARLACANITVNIVYGLTVALLAMGLDSILIAISYGFILHAVFHLPSHDAQHKALSTCGSHIGIILVFYIPAFFSFLTHRFGHHEVPKHVHIFLANLYVLVPPVLNPILYGARTKEIRSRLLKLLHLGKTSI

SEQ ID NO: 126 - protein, 321 aa, Artificial sequence
  synthetic
MLTLNKTDLIPASFILNGVPGLEDTQLWISFPFCSMYVVAMVGNCGLLYLIHYEDALHKPMYYFLAMLSFTDLVMCSSTIPKALCIFWFHLKDIGFDECLVQMFFTHTFTGMESGVLMLMALDRYVAICYPLRYSTILTNPVIAKVGTATFLRGVLLIIPFTFLTKLLPYCRGNILPHTYCDHMSVAKLSCGNVKVNAIYGLMVALLIWGFDILCITNSYTMILRAVVSLSSADARQKAFNTCTAHICAIVFSYTPAFFSFFSHRFGEHIIPPSCHIIVANIYLLLPPTMNPIVYGVKTKQIRDCVIRILSGSKDTKSYSM

SEQ ID NO: 127 - protein, 320 aa, Artificial sequence
  synthetic
MSFLNGTSLTPASFILNGIPGLEDVHLWISFPLCTMYSIAITGNFGLMYLIYCDEALHRPMYVFLALLSFTDVLMCTSTLPNTLFILWFNLKEIDFKACLAQMFFVHTFTGMESGVLMLMALDHCVAICFPLRYATILTNSVIAKAGFLTFLRGVMLVIPSTFLTKRLPYCKGNVIPHTYCDHMSVAKISCGNVRVNAIYGLIVALLIGGFDILCITISYTMILQAVVSLSSADARQKAFSTCTAHFCAIVLTYVPAFFTFFTHHFGGHTIPLHIHIIMANLYLLMPPTMNPIVYGVKTRQVRESVIRFFLKGKDNSHNF

SEQ ID NO: 128 - protein, 321 aa, Artificial sequence
  synthetic
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYDK

SEQ ID NO: 129 - protein, 324 aa, Artificial sequence
  synthetic
MPLFNSLCWFPTIHVTPPSFILNGIPGLERVHVWISLPLCTMYIIFLVGNLGLVYLIYYEESLHHPMYFFFGHALSLIDLLTCTTTLPNALCIFWFSLKEINFNACLAQMFFVHGFTGVESGVLMLMALDRYVAICYPLRYATTLTNPIIAKAELATFLRGVLLMIPFPFLVKRLPFCQSNIISHTYCDHMSVVKLSCASIKVNVIYGLMVALLIGVFDICCISLSYTLILKAAISLSSSDARQKAFSTCTAHISAIIITYVPAFFTFFAHRFGGHTIPPSLHIIVANLYLLLPPTLNPIVYGVKTKQIRKSVIKFFQGDKGAG

SEQ ID NO: 130 - protein, 314 aa, Artificial sequence
  synthetic
MIIFNLSSYNPGPFILVGIPGLEQFHVWIGIPFCIIYIVAVVGNCILLYLIVVEHSLHEPMFFFLSMLAMTDLILSTAGVPKALSIFWLGAREITFPGCLTQMFFLHYNFVLDSAILMAMAFDHYVAICSPLRYTTILTPKTIIKSAMGISFRSFCIILPDVFLLTCLPFCRTRIIPHTYCEHIGVAQLACADISINFWYGFCVPIMTVISDVILIAVSYAHILCAVFGLPSQDACQKALGTCGSHVCVILMFYTPAFFSILAHRFGHNVSRTFHIMFANLYIVIPPALNPMVYGVKTKQIRDKVILLFSKGTG

SEQ ID NO: 131 - protein, 314 aa, Artificial sequence
  synthetic
MSASNITLTHPTAFLLVGIPGLEHLHIWISIPFCLAYTLALLGNCTLLLIIQADAALHEPMYLFLAMLAAIDLVLSSSALPKMLAIFWFRDREINFFACLAQMFFLHSFSIMESAVLLAMAFDRYVAICKPLHYTKVLTGSLITKIGMAAVARAVTLMTPLPFLLRCFHYCRGPVIAHCYCEHMAVVRLACGDTSFNNIYGIAVAMFIVVLDLLLVILSYIFILQAVLLLASQEARYKAFGTCVSHIGAILAFYTTVVISSVMHRVARHAAPHVHILLANFYLLFPPMVNPIIYGVKTKQIRESILGVFPRKDM

SEQ ID NO: 132 - protein, 314 aa, Artificial sequence
  synthetic
MLPSNITSTHPAVFLLVGIPGLEHLHAWISIPFCFAYTLALLGNCTLLFIIQADAALHEPMYLFLAMLATIDLVLSSTTLPKMLAIFWFRDQEINFFACLVQMFFLHSFSIMESAVLLAMAFDRYVAICKPLHYTTVLTGSLITKIGMAAVARAVTLMTPLPFLLRRFHYCRGPVIAHCYCEHMAVVRLACGDTSFNNIYGIAVAMFIVVLDLLFVILSYVFILQAVLQLASQEARYKAFGTCVSHIGAILSTYTPVVISSVMHRVARHAAPRVHILLAIFYLLFPPMVNPIIYGVKTKQIREYVLSLFQRKNM

SEQ ID NO: 133 - protein, 315 aa, Artificial sequence
  synthetic
MVLASGNSSSHPVSFILLGIPGLESFQLWIAFPFCATYAVAVVGNITLLHVIRIDHTLHEPMYLFLAMLAITDLVLSSSTQPKMLAIFWFHAHEIQYHACLIQVFFIHAFSSVESGVLMAMALDCYVAICFPLRHSSILTPSVVIKLGTIVMLRGLLWVSPFCFMVSRMPFCQHQAIPQSYCEHMAVLKLVCADTSISRGNGLFVAFSVAGFDMIVIGMSYVMILRAVLQLPSGEARLKAFSTRSSHICVILALYIPALFSFLTYRFGHDVPRVVHILFANLYLLIPPMLNPIIYGVRTKQIGDRVIQGCCGNIP

SEQ ID NO: 134 - protein, 314 aa, Artificial sequence
  synthetic
MLLSNSSWRLSQPSFLLVGIPGLEESQHWIALPLGILYLLALVGNVTILFIIWMDPSLHQSMYLFLSMLAAIDLVLASSTAPKALAVLLVHAHEIGYIVCLIQMFFIHAFSSMESGVLVAMALDCYVAICHPLHHSTILHPGVIGCIGMVVLVRGLLLLIPFPILLGKLIFCQATIIGHAYCEHMAVVKLACSETTVNRAYGLTMALLVIGLDVLAIGVSYAHILQAVLKVPGSEARLKAFSTCGSHICVILVFYVPGIFSFLTHRFGHHVPHHVHVLLATWYLLMPPALNPLVYGVKTQQIRQRVLRVFTQKD

SEQ ID NO: 135 - protein, 304 aa, Artificial sequence
  synthetic
MALPITNGTLFMPFVLTFIGIPGFESVQCWIGIPFCATYVIALIGNSLLLIIIKSEPSLHEPMYIFLATLGATDISLSTSIVPKMLDIFWFHLPEIYFDACLFQMWLIHTFQGIESGVLLAMALDRCVAICYPLRRAIVFTRQLVTYIVVGVTLRPAILVIPCLLLIKCHLKLYRTKLIYHTYCERVALVKLATEDVYINKVYGILGAFIVGGLDFIFITLSYIQIFITVFHLPLKEARLKVFNTCIPHIYVFFQFYLLAFFFIFYSQIWILYPIICTYHLVQSLPTGPTIPQPLYLWVKDQTH

SEQ ID NO: 136 - protein, 316 aa, Artificial sequence
  synthetic
MPTFNGSVFMPSAFILIGIPGLESVQCWIGIPFSAMYLIGVIGNSLILVIIKYENSLHIPMYIFLAMLAATDIALNTCILPKMLGIFWFHLPEISFDACLFQMWLIHSFQAIESGILLAMALDRYVAICIPLRHATIFSQQFLTHIGLGVTLRAAILIIPSLGLIKCCLKHYRTTVISHSYCEHMAIVKLATEDIRVNKIYGLFVAFAILGFDIIFITLSYVQIFITVFQLPQKEARFKAFNTCIAHICVFLQFYLLAFFSFFTHRFGSHIPPYIHILLSNLYLLVPPFLNPIVYGVKTKQIRDHIVKVFFFKKVT

SEQ ID NO: 137 - protein, 312 aa, Artificial sequence
  synthetic
MSISNITVYMPSVLTLVGIPGLESVQCWIGIPFCAIYLIAMIGNSLLLSIIKSERSLHEPLYIFLGMLGATDIALASSIMPKMLGIFWFNVPEIYFDSCLLQMWFIHTLQGIESGILVAMALDRYVAICYPLRHANIFTHQLVIQIGTMVVLRAAILVAPCLVLIKCRFQFYHTTVISHSYCEHMAIVKLAAANVQVNKIYGLFVAFTVAGFDLTFITLSYIQIFITVFRLPQKEARFKAFNTCIAHICVFLQFYLLAFFSFFTHRFGSHISPYIHILFSSIYLLVPPFLNPLVYGAKTTQIRIHVVKMFCS

SEQ ID NO: 138 - protein, 314 aa, Artificial sequence
  synthetic
MNNSDTRIAGCFLTGIPGLEQLHIWLSIPFCIMYITALEGNGILICVILSQAILHEPMYIFLSMLASADVLLSTTTMPKALANLWLGYSLISFDGCLTQMFFIHFLFIHSAVLLAMAFDRYVAICSPLRYVTILTSKVIGKIVTAALSHSFIIMFPSIFLLEHLHYCQINIIAHTFCEHMGIAHLSCSDISINVWYGLAAALLSTGLDIMLITVSYIHILQAVFRLLSQDARSKALSTCGSHICVILLFYVPALFSVFAYRFGGRSVPCYVHILLASLYVVIPPMLNPVIYGVRTKPILEGAKQMFSNLAKGSK

SEQ ID NO: 139 - protein, 314 aa, Artificial sequence
  synthetic
MPTVNHSGTSHTVFHLLGIPGLQDQHMWISIPFFISYVTALLGNSLLIFIILTKRSLHEPMYLFLCMLAGADIVLSTCTIPQALAIFWFRAGDISLDRCITQLFFIHSTFISESGILLVMAFDHYIAICYPLRYTTILTNALIKKICVTVSLRSYGTIFPIIFLLKRLTFCQNNIIPHTFCEHIGLAKYACNDIRINIWYGFSILMSTVVLDVVLIFISYMLILHAVFHMPSPDACHKALNTFGSHVCIIILFYGSGIFTILTQRFGRHIPPCIHIPLANVCILAPPMLNPIIYGIKTKQIQEQVVQFLFIKQK

SEQ ID NO: 140 - protein, 317 aa, Artificial sequence
  synthetic
MLTFHNVCSVPSSFWLTGIPGLESLHVWLSIPFGSMYLVAVVGNVTILAVVKIERSLHQPMYFFLCMLAAIDLVLSTSTIPKLLGIFWFGACDIGLDACLGQMFLIHCFATVESGIFLAMAFDRYVAICNPLRHSMVLTYTVVGRLGLVSLLRGVLYIGPLPLMIRLRLPLYKTHVISHSYCEHMAVVALTCGDSRVNNVYGLSIGFLVLILDSVAIAASYVMIFRAVMGLATPEARLKTLGTCASHLCAILIFYVPIAVSSLIHRFGQCVPPPVHTLLANFYLLIPPILNPIVYAVRTKQIRESLLQIPRIEMKIR

SEQ ID NO: 141 - protein, 320 aa, Artificial sequence
  synthetic
MAETLQLNSTFLHPNFFILTGFPGLGSAQTWLTLVFGPIYLLALLGNGALPAVVWIDSTLHQPMFLLLAILAATDLGLATSIAPGLLAVLWLGPRSVPYAVCLVQMFFVHALTAMESGVLLAMACDRAAAIGRPLHYPVLVTKACVGYAALALALKAVAIVVPFPLLVAKFEHFQAKTIGHTYCAHMAVVELVVGNTQATNLYGLALSLAISGMDILGITGSYGLIAHAVLQLPTREAHAKAFGTCSSHICVILAFYIPGLFSYLTHRFGHHTVPKPVHILLSNIYLLLPPALNPLIYGARTKQIRDRLLETFTFRKSPL

SEQ ID NO: 142 - protein, 324 aa, Artificial sequence
  synthetic
MLGPAYNHTMETPASFLLVGIPGLQSSHLWLAISLSAMYIIALLGNTIIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAITIRAIIAITPLSWMVSHLPFCGSNVVVHSYCEHIALARLACADPVPSSLYSLIGSSLMVGSDVAFIAASYILILKAVFGLSSKTAQLKALSTCGSHVGVMALYYLPGMASIYAAWLGQDVVPLHTQVLLADLYVIIPATLNPIIYGMRTKQLRERIWSYLMHVLFDHSNLGS

SEQ ID NO: 143 - protein, 324 aa, Artificial sequence
  synthetic
MLGPAYNHTMETPASFLLVGIPGLQSSHLWLAISLSAMYITALLGNTLIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAVTIRAVTFMTPLSWMMNHLPFCGSNVVVHSYCKHIALARLACADPVPSSLYSLIGSSLMVGSDVAFIAASYILILRAVFDLSSKTAQLKALSTCGSHVGVMALYYLPGMASIYAAWLGQDIVPLHTQVLLADLYVIIPATLNPIIYGMRTKQLLEGIWSYLMHFLFDHSNLGS

SEQ ID NO: 144 - protein, 310 aa, Artificial sequence
  synthetic
MEENQTSSTDFILLGLFDHPRLELLLFVLILLIYLLALLGNGLIILLIHLDSRLHTPMYFFLSQLSLMDLCYTSTTVPKMLVNLLSGDKTISFAGCGAQLFLYLTLGGTECLLLAVMAYDRYVAICHPLRYPVLMNPRVCLLLAAGSWLLGSLDSLIHTVLTLSLPFCGSREINHFFCEVPALLKLACADTSLNETVMFVCCVLMLLIPLSLILVSYGRILLAVLRMQSAEGRRKAFSTCSSHLTVVGLFYGAAIYMYLQPKSYHSPEQDKVVSLFYTILTPMLNPLIYSLRNKEVKGALRRVLGKCRSL

SEQ ID NO: 145 - protein, 308 aa, Artificial sequence
  synthetic
MNENNETLTRGFTLMGLFTHNKCSGFFFGVICAVFFMAMIANGVMIFLINIDPHLHTPMYFLLSHLSVIDTLYISTIVPKMLVDYLMGEGTISFIACTAQCFLYMGFMGAEFFLLGLMAYDRYVAICNPLRYPVLISWRVCWMILASSWFGGALDSFLLTPITMSLPFCASHQINHFFCEAPTMLRLACGDKTTYETVMYVCCVAMLLIPFSVVTASYTRILITVHQMTSAEGRKKAFATCSSHMMVVTLFYGAALYTYTLPQSYHTPIKDKVFSAFYTILTPLLNPLIYSLRNRDVMGALKRVVARC

SEQ ID NO: 146 - protein, 318 aa, Artificial sequence
  synthetic
MEEYNTSSTDFTFMGLFNRKETSGLIFAIISIIFFTALMANGVMIFLIQTDLRLHTPMYFLLSHLSLIDMMYISTIVPKMLVNYLLDQRTISFVGCTAQHFLYLTLVGAEFFLLGLMAYDRYVAICNPLRYPVLMSRRVCWMIIAGSWFGGSLDGFLLTPITMSFPFCNSREINHFFCEAPAVLKLACADTALYETVMYVCCVLMLLIPFSVVLASYARILTTVQCMSSVEGRKKAFATCSSHMTVVSLFYGAAMYTYMLPHSYHKPAQDKVLSVFYTILTPMLNPLIYSLRNKDVTGALKRALGRFKGPQRVSGGVF

SEQ ID NO: 147 - protein, 308 aa, Artificial sequence
  synthetic
MPTLSFWVCSATPVSPGFFALILLVFVTSIASNVVKIILIHIDSRLHTPMYFLLSQLSLRDILYISTIVPKMLVDQVMSQRAISFAGCTAQHFLYLTLAGAEFFLLGLMSCDRYVAICNPLHYPDLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRRKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 148 - protein, 317 aa, Artificial sequence
  synthetic
MEQSNYSVYADFILLGLFSNARFPWLLFALILLVFLTSIASNVVKIILIHIDSRLHTPMYFLLSQLSLRDILYISTIVPKMLVDQVMSQRAISFAGCTAQHFLYLTLAGAEFFLLGLMSYDRYVAICNPLHYPVLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRGKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 149 - protein, 322 aa, Artificial sequence
  synthetic
MEGLLQNSTNFVLTGLITHPAFPGLLFAIVFSIFVVAITANLVMILLIHMDSRLHTPMYFLLSQLSIMDTIYICITVPKMLQDLLSKDKTISFLGCAVQIFLYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 150 - protein, 321 aa, Artificial sequence
  synthetic
MEGLLQNSTNFVLTGLITHPAFPGLLFAVVFSIFVVAITANLVMILLIHMDSRLHTPMYFLLSQLSIMDTIYICITVPKMLQDLLSKDKTISFLGCAVQIFYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 151 - protein, 316 aa, Artificial sequence
  synthetic
MTNTSSSDFTLLGLLVNSEAAGIVFTVILAVFLGAVTANLVMIFLIQVDSRLHTPMYFLLSQLSIMDTLFICTTVPKLLADMVSKEKIISFVACGIQIFLYLTMIGSEFFLLGLMAYDCYVAVCNPLRYPVLMNRKKCLLLAAGAWFGGSLDGFLLTPITMNVPYCGSRSINHFFCEIPAVLKLACADTSLYETLMYICCVLMLLIPISIISTSYSLILLTIHRMPSAEGRKKAFTTCSSHLTVVSIFYGAAFYTYVLPQSFHTPEQDKVVSAFYTIVTPMLNPLIYSLRNKDVIGAFKKVFACCSSAQKVATSDA

SEQ ID NO: 152 - protein, 312 aa, Artificial sequence
  synthetic
MAWENQTFNSDFILLGIFNHSPTHTFLFFLVLAIFSVAFMGNSVMVLLIYLDTQLHTPMYFLLSQLFLMDLMLICSTVPKMAFNYLSGSKSISMAGCATQIFFYVSLLGSECFLLAVMSYDRYIAICHPLRYTNLMRPKICGLMTAFSWILGSMDAIIDAVATFSFSYCGSREIAHFFCDFPSLLILSCNDTSIFEKVLFICCIVMIVFPVAIIIASYARVILAVIHMGSGEGRRKAFTTCSSHLMVVGMYYGAGLFMYIRPTSDRSPMQDKLVSVFYTILTPMLNPLIYSLRNKEVTRALRKVLGKGKCGE

SEQ ID NO: 153 - protein, 312 aa, Artificial sequence
  synthetic
MARENSTFNSDFILLGIFNHSPTHTFLFFLVLAIFSVAFMGNSVMVLLIYLDTQLHTPMYLLLSQLSLMDLMLICTTVPKMAFNYLSGSKSISMAGCATQIFFYTSLLGSECFLLAVMAYDRYTAICHPLRYTNLMSPKICGLMTAFSWILGSTDGIIDVVATFSFSYCGSREIAHFFCDFPSLLILSCSDTSIFEKILFICCIVMIVFPVAIIIASYARVILAVIHMGSGEGRRKAFTTCSSHLLVVGMYYGAALFMYIRPTSDRSPTQDKMVSVFYTILTPMLNPLIYSLRNKEVTRAFMKILGKGKSGE

SEQ ID NO: 154 - protein, 312 aa, Artificial sequence
  synthetic
MAWENQTFNSDFLLLGIFNHSPTHTFLFFLVLAIFSVAFMGNSIMVLLIYLDTQLHTPMYFLLSQLSLMDLMLICTTVPKMAFNYLSGSKSISMAGCATQIFFYISLLGSECFLLAVMSYDRYTAICHPLRYTNLMRPKICGLMTAFSWILGSTDGIIDAVATFSFSYCGSREIAHFCCDFPSLLILSCNDTSIFEEVIFICCIVMLVFPVAIIITSYARVILAVIHMGSGEGRRKAFTTCSSHLMVVGMYYGAGLFMCIQPTSHHSPMQDKMVSVFYTIVTPMLNPLIYSLRNKEVTRALMKILGKGKSGD

SEQ ID NO: 155 - protein, 347 aa, Artificial sequence
  synthetic
MAWENQTFNSDFILLGIFNHSPPHTFLFFLVLGIFLVAFMGNSVMVLLIYLDTQLHTPMYFLLSQLSLMDLMLICTTVPKMAFNYLSGSKSISMAGCVTQIFFYISLSGSECFLLAVMAYDRYIAICHPLRYTNLMNPKICGLMATFSWILGSTDGIIDAVATFSFSFCGSREIAHFFCEFPSLLILSCNDTSIFEEVIFICCIVMLVFPVAIIIASYARVILAVIHMGSGEGRCKAFTTCSSHLMVVGMYYGAALFMYIRPTSDHSPTQDKMVSVFYTILTPMLNPLIYSLRNKEVTRAFMKILGKGKSESELPHKLYVLLFAKFFFLISIFFYDVKILALIMYIA

SEQ ID NO: 156 - protein, 311 aa, Artificial sequence
  synthetic
MVWENQTFNSIFILLGIFNHSPTHTFLFSLVLGIFSLALMENISMVLLIYIEKQLHTPMYFLLSQLSLMDLMLICTTLPKMIFSYLSGKKSISLAGCGTQIFFYVSLLGAECFLLAVMAYDRYVAICHPLQYTILMNPKLCVFMTVASWTLGSLDGIIVLAAVLSFSYCSSLEIHHFFCDVAALLPLSCTETSAFERLLVICCVVMLIFPVSVIILSYSHVLRAVIHMGSGESRRKAFTTCSSHLSVVGLYYGAAMFMYMRPASKHTPDQDKMVSAFYTILTPMLNPLIYSLRNKEVFRALQKVLKKRKLI

SEQ ID NO: 157 - protein, 312 aa, Artificial sequence
  synthetic
MENGSYTSYFILLGLFNHTRAHQVLFMMVLSIVLTSLFGNSLMILLIHWDHRLHTPMYFLLSQLSLMDVMLVSTTVPKMAADYLTGSKAISRAGCGAQIFFLPTLGGGECFLLAAMAYDRYAAVCHPLRYPTLMSWQLCLRMNLSCWLLGAADGLLQAVATLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALTRCMGRCVALSRE

SEQ ID NO: 158 - protein, 320 aa, Artificial sequence
  synthetic
MEMRNTTPDFILLGLFNHTRAHQVLFMMVLSIVLTSLFGNSLMILLIHWDHRLHTPMYFLLSQLSLMDMMLVSTTVPKMAADYLTGSKAISRAGCGVQIFFLPTLGGGECFLLAAMAYDRYAAVCHPLRYPTLMSWQLCLRMTMSCWLLGAADGLLQAVVTLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALKRWLGTCVNIKHQQNEAHRSR

SEQ ID NO: 159 - protein, 320 aa, Artificial sequence
  synthetic
MEMRNTTPDFILLGLFNHTRAHQVLFMMLLATVLTSLFSNALMILLIHWDHRLHRPMYFLLSQLSLMDMMLVSTTVPKMAADYLTGNKAISRAGCGVQIFFLPTLGGGECFLLAAMAYDRYAAVCHPLRYPTLMSWQLCLRMTMSSWLLGAADGLLQAVATLSFPYCGAHEIDHFFCEAPVLVRLACADTSVFENAMYICCVLMLLVPFSLILSSYGLILAAVLLMRSTEARKKAFATCSSHVAVVGLFYGAGIFTYMRPKSHRSTNHDKVVSAFYTMFTPLLNPLIYSVRNSEVKEALKRWLGTCVNLKHQQNEAHRSR

SEQ ID NO: 160 - protein, 330 aa, Artificial sequence
  synthetic
MGLFRQSKHPMANITWMANHTGWSDFILLGLFRQSKHPALLCVVIFVVFLMALSGNAVLILLIHCDAHLHTPMYFFISQLSLMDMAYISVTVPKMLLDQVMGVNKISAPECGMQMFFYVTLAGSEFFLLATMAYDRYVAICHPLRYPVLMNHRVCLFLSSGCWFLGSVDGFTFTPITMTFPFRGSREIHHFFCEVPAVLNLSCSDTSLYEIFMYLCCVLMLLIPVVIISSSYLLILLTIHGMNSAEGRKKAFATCSSHLTVVILFYGAAIYTYMLPSSYHTPEKDMMVSVFYTILTPVVNPLIYSLRNKDVMGALKKMLTVEPAFQKAME

SEQ ID NO: 161 - protein, 309 aa, Artificial sequence
  synthetic
MANHTGKLDFILMGLFRRSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 162 - protein, 309 aa, Artificial sequence
  synthetic
MANHTGRLDFILMGLFRQSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 163 - protein, 312 aa, Artificial sequence
  synthetic
MRLANQTLGGDFFLLGIFSQISHPGRLCLLIFSIFLMAVSWNITLILLIHIDSSLHTPMYFFINQLSLIDLTYISVTVPKMLVNQLAKDKTISVLGCGTQMYFYLQLGGAECCLLAAMAYDRYVAICHPLRYSVLMSHRVCLLLASGCWFVGSVDGFMLTPIAMSFPFCRSHEIQHFFCEVPAVLKLSCSDTSLYKIFMYLCCVIMLLIPVTVISVSYYYIILTIHKMNSVEGRKKAFTTCSSHITVVSLFYGAAIYNYMLPSSYQTPEKDMMSSFFYTILTPVLNPIIYSFRNKDVTRALKKMLSVQKPPY

SEQ ID NO: 164 - protein, 318 aa, Artificial sequence
  synthetic
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFYLTLAGAEVFLLAAMAYDRYAAVCRPLHYPLLMNQRVCQLLVSACWVLGMVDGLLLTPITMSFPFCQSRKILSFFCETPALLKLSCSDVSLYKTLMYLCCILMLLAPIMVISSSYTLILHLIHRMNSAAGHRKALATCSSHMIIVLLLFGASFYTYMLPSSYHTAEQDMMVSAFYTIFTPVLNPLIYSLRNKDVTRALRSMMQSRMNQEK

SEQ ID NO: 165 - protein, 318 aa, Artificial sequence
  synthetic
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLRSSYHTAEQDMMVSAFYTIFTPVLNPLIYSLRNKDVTRALRSMMQSRMNQEK

SEQ ID NO: 166 - protein, 315 aa, Artificial sequence
  synthetic
MGRWVNQSYTDGFFLLGIFSHSQTDLVLFSAVMVVFTVALCGNVLLIFLIYLDAGLHTPMYFFLSQLSLMDLMLVCNIVPKMAANFLSGRKSISFVGCGIQIGFFVSLVGSEGLLLGLMAYDRYVAVSHPLHYPILMNQRVCLQITGSSWAFGIIDGVIQMVAAMGLPYCGSRSVDHFFCEVQALLKLACADTSLFDTLLFACCVFMLLLPFSIIMASYACILGAVLRIRSAQAWKKALATCSSHLTAVTLFYGAAMFMYLRPRRYRAPSHDKVASIFYTVLTPMLNPLIYSLRNGEVMGALRKGLDRCRIGSQH

SEQ ID NO: 167 - protein, 315 aa, Artificial sequence
  synthetic
METWVNQSYTDGFFLLGIFSHSTADLVLFSVVMAVFTVALCGNVLLIFLIYMDPHLHTPMYFFLSQLSLMDLMLVCTNVPKMAANFLSGRKSISFVGCGIQIGLFVCLVGSEGLLLGLMAYDRYVAISHPLHYPILMNQRVCLQITGSSWAFGIIDGLIQMVVVMNFPYCGLRKVNHFFCEMLSLLKLACVDTSLFEKVIFACCVFMLLFPFSIIVASYAHILGTVLQMHSAQAWKKALATCSSHLTAVTLFYGAAMFIYLRPRHYRAPSHDKVASIFYTVLTPMLNPLIYSLRNREVMGALRKGLDRCRIGSQH

SEQ ID NO: 168 - protein, 310 aa, Artificial sequence
  synthetic
MGDNITSIREFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFRTCFSHLCVIGLVYGTAIIMYVGPRYGNPKEQKKYLLLFHSLFNPMLNPLICSLRNSEVKNTLKRVLGVERAL

SEQ ID NO: 169 - protein, 310 aa, Artificial sequence
  synthetic
MGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFCTCFSHLCVIGLFYGTAIIMYVGPRYGNPKEQKKYLLLFHSLFNPMLNPLICSLRNSEVKNTLKRVLGVERAL

SEQ ID NO: 170 - protein, 310 aa, Artificial sequence
  synthetic
MGGNQTSITEFLLLGFPIGPRIQMLLFGLFSLFYIFILLGNGTILGLISLDSRLHTPMYFFLSHLAVVDIACACSTVPQMLVNLLHPAKPISFAGCMTQMFLFLSFAHTECLLLVVMSYDRYVAICHPLRYSTIMTWKVCITLALTSWILGVLLALVHLVLLLPLSFCGPQKLNHFFCEIMAVLKLACADTHINEVMVLAGAVSVLVGAFFSTVISYVHILCAILKIQSGEGCQKAFSICSSHLCVVGLFYGTAIIMYVEPQYESPKEQKKYLLLFHSLFNPMLNPLIYSLRNKEVQGTLKRMLEKKRTS

SEQ ID NO: 171 - protein, 311 aa, Artificial sequence
  synthetic
MTKNQTWVTEFILLGFPLSLRIQMLLSGLFSLLYVFTLLGNGAILGLIWLDSRLHTPMYFFLSHLAIIDISYASNNVPKMLTNLGLNKRKTISFVPCTMQTFLYMAFAHTECLILVMMSYDRYMAICHPLQYSVIMRWGVCTVLAVTSWACGSLLALVHVVLILRLPFCGPHEINHFFCEILSVLKLACADTWLNQVVIFAASVFILVGPLCLVLVSYSRILAAILRIQSGEGRRKAFSTCSSHLCMVGLFFGSAIVMYMAPKSRHPEEQQKVLSLFYSLFNPMLNPLIYSLRNAEVKGALKRVLWKQRSK

SEQ ID NO: 172 - protein, 310 aa, Artificial sequence
  synthetic
MGENQTMVTEFLLLGFLLGPRIQMLLFGLFSLFYIFTLLGNGAILGLISLDSRLHTPMYFFLSHLAVVDIAYTRNTVPQMLANLLHPAKPISFAGCMTQTFLCLSFGHSECLLLVLMSYDRYVAICHPLRYSVIMTWRVCITLAVTSWTCGSLLALAHVVLILRLPFSGPHEINHFFCEILSVLRLACADTWLNQVVIFAACVFFLVGPPSLVLVSYSHILAAILRIQSGEGRRKAFSTCSSHLCVVGLFFGSAIIMYMAPKSRHPEEQQKVFFLFYSFFNPTLNPLIYSLRNGEVKGALRRALGKESHS

SEQ ID NO: 173 - protein, 310 aa, Artificial sequence; identical to SEQ ID NO: 172
  synthetic

SEQ ID NO: 174 - protein, 318 aa, Artificial sequence
  synthetic
MEGNQTWITDITLLGFQVGPALAILLCGLFSVFYTLTLLGNGVIFGIICLDSKLHTPMYFFLSHLAIIDMSYASNNVPKMLANLMNQKRTISFVPCIMQTFLYLAFAVTECLILVVMSYDRYVAICHPFQYTVIMSWRVCTILVLTSWSCGFALSLVHEILLLRLPFCGPRDVNHLFCEILSVLKLACADTWVNQVVIFATCVFVLVGPLSLILVSYMHILGAILKIQTKEGRIKAFSTCSSHLCVVGLFFGIAMVVYMVPDSNQREEQEKMLSLFHSVFNPMLNPLIYSLRNAQLKGALHRALQRKRSMRTVYGLCL

SEQ ID NO: 175 - protein, 310 aa, Artificial sequence
  synthetic
MEGNKTWITDITLPRFQVGPALEILLCGLFSAFYTLTLLGNGVIFGIICLDCKLHTPMYFFLSHLAIVDISYASNYVPKMLTNLMNQESTISFFPCIMQTFLYLAFAHVECLILVVMSYDRYADICHPLRYNSLMSWRVCTVLAVASWVFSFLLALVPLVLILSLPFCGPHEINHFFCEILSVLKLACADTWLNQVVIFAACVFILVGPLCLVLVSYLRILAAILRIQSGEGRRKAFSTCSSHLCVVGLFFGSAIVTYMAPKSRHPEEQQKVLSLFYSLFNPMLNPLIYSLRNAEVKGALRRALRKERLT

SEQ ID NO: 176 - protein, 310 aa, Artificial sequence
  synthetic
MESNQTWITEVILLGFQVDPALELFLFGFFLLFYSLTLMGNGIILGLIYLDSRLHTPMYVFLSHLAIVDMSYASSTVPKMLANLVMHKKVISFAPCILQTFLYLAFAITECLILVMMCYDRYVAICHPLQYTLIMNWRVCTVLASTCWIFSFLLALVHITLILRLPFCGPQKINHFFCQIMSVFKLACADTRLNQVVLFAGSAFILVGPLCLVLVSYLHILVAILRIQSGEGRRKAFSTCSSHLCVVGLFFGSAIVMYMAPKSSHSQERRKILSLFYSLFNPILNPLIYSLRNAEVKGALKRVLWKQRSM

SEQ ID NO: 177 - protein, 312 aa, Artificial sequence
  synthetic
MENYNQTSTDFILLGLFPPSRIDLFFFILIVFIFLMALIGNLSMILLIFLDTHLHTPMYFLLSQLSLIDLNYISTIVPKMASDFLHGNKSISFTGCGIQSFFFLALGGAEALLLASMAYDRYIAICFPLHYLIRMSKRVCVLMITGSWIIGSINACAHTVYVLHIPYCRSRAINHFFCDVPAMVTLACMDTWVYEGTVFLSATIFLVFPFIGISCSYGQVLFAVYHMKSAEGRKKAYLTCSTHLTVVTFYYAPFVYTYLRPRSLRSPTEDKVLAVFYTILTPMLNPIIYSLRNKEVMGALTRVSQRICSVKM

SEQ ID NO: 178 - protein, 312 aa, Artificial sequence
  synthetic
MENYNQTSTDFILLGFFPPSRIGLFLFILIVFIFLMALIGNLSMILLIFLDTHLHTPMYFLLSQLSLIDLNYISTIVPKMASDFLSGNKSISFTGCGIQSFFFSALGGAEALLLASMAYDRYIAICFPLHYPIRMSKRMCVLMITGSWIIGSINACAHTVYVLHIPYCQSRAINHFFCDVPAMVTLACMDTWVYEGTVFLSTTIFLVFPFIAISCSYGRVLLAVYHMKSAEGRKKAYLTCSTHLTVVTFYYAPFVYTYLRPRSLRSPTEDKVLAVFYTTLTPMLNPIIYSLRNKEVMGALTRVSQRICSGKM

SEQ ID NO: 179 - protein, 312 aa, Artificial sequence
  synthetic
MENYNQTSTDFILLGLFPPSKIGLFLFILFVLIFLMALIGNLSMILLIFLDTHLHTPMYFLLSQLSLIDLNYISTIVPKMASDFLYGNKSISFIGCGIQSFFFMTFAGAEALLLTSMAYDRYVAICFPLHYPIRMSKRMYVLMITGSWMIGSINSCAHTVYAFRIPYCKSRAINHFFCDVPAMLTLACTDTWVYEYTVFLSSTIFLVFPFTGIACSYGWVLLAVYRMHSAEGRKKAYSTCSTHLTVVTFYYAPFAYTYLCPRSLRSLTEDKVLAVFYTILTPMLNPIIYSLRNKEVMGALTRVIQNIFSVKM

SEQ ID NO: 180 - protein, 312 aa, Artificial sequence
  synthetic
MENYNQTSTDFILLGLFPQSRIGLFVFTLIFLIFLMALIGNLSMILLIFLDIHLHTPMYFLLSQLSLIDLNYISTIVPKMVYDFLYGNKSISFTGCGIQSFFFLTLAVAEGLLLTSMAYDRYVAICFPLHYPIRISKRVCVMMITGSWMISSINSCAHTVYALCIPYCKSRAINHFFCDVPAMLTLACTDTWVYESTVFLSSTIFLVLPFTGIACSYGRVLLAVYRMHSAEGRKKAYSTCSTHLTVVSFYYAPFAYTYVRPRSLRSPTEDKILAVFYTILTPMLNPIIYSLRNKEVMGALTQVIQKIFSVKM

SEQ ID NO: 181 - protein, 312 aa, Artificial sequence
  synthetic
MEKWNHTSNDFILLGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMAYDRYLAICHSLYYPIRMSKMMCVKMIGGSWTLGSINSLAHTVFALHIPYCRSRAIDHFFCDVPAMLLLACTDTWVYEYMVFVSTSLFLLFPFIGITSSCGRVLFAVYHMHSKEGRKKAFTTISTHLTVVIFYYAPFVYTYLRPRNLRSPAEDKILAVFYTILTPMLNPIIYSLRNKEVLGAMRRVFGIFSFLKE

SEQ ID NO: 182 - protein, 329 aa, Artificial sequence
  synthetic
MMGHQNHTFSSDFILLGLFSSSPTSVVFFLVLFVIFIMSVTENTLMILLIRSDSRLHTPMYFLLSHLSLMDILHVSNIVPKMVTNFLSGSRTISFAGCGFQVFLSLTLLGGECLLLAAMSCDRYVAICHPLRYPILMKEYASALMAGGSWLIGVFNSTVHTAYALQFPFCGSRAIDHFFCEVPAMLKLSCADTTRYERGVCVSAVIFLLIPFSLISASYGQIILTVLQMKSSEARKKSFSTCSFHMIVVTMYYGPFIFTYMRPKSYHTPGQDKFLAIFYTILTPTLNPFIYSFRNKDVLAVMKNMLKSNFLHKKMNRKIPECVFCLFLC

SEQ ID NO: 183 - protein, 320 aa, Artificial sequence
  synthetic
MKTGNQSFGTDFLLVGLFQYGWINSLLFVVIATLFTVALTGNIMLIHLIRLNTRLHTPMYFLLSQLSIVDLMYISTTVPKMAVSFLSQSKTIRFLGCEIQTYVFLALGGTEALLLGFMSYDRYVAICHPLHYPMLMSKKICCLMVACAWASGSINAFIHTLYVFQLPFCRSRLINHFFCEVPALLSLVCQDTSQYEYTVLLSGLIILLLPFLAILASYARVLIVVFQMSSGKGQAKAVSTCSSHLIVASLFYATTLFTYTRPHSLRSPSRDKAVAVFYTIVTPLLNPFIYSLRNKEVTGAVRRLLGYWICCRKYDFRSLY

SEQ ID NO: 184 - protein, 316 aa, Artificial sequence
  synthetic
MELRNSTLGSGFILVGILNDSGSPELLYATFTILYMLALTSNGLLLLAITIEARLHMPMYLLLGQLSLMDLLFTSVVTPKALADFLRRENTISFGGCALQMFLALTMGSAEDLLLAFMAYDRYVAICHPLKYMTLMSPRVCWIMVATSWILASLIAIGHTMYTMHLPFCVSWEIRHLLCEIPPLLKLACADTSRYELIIYVTGVTFLLLPISAIVASYTLVLFTVLRMPSNEGRKKALVTCSSHLIVVGMFYGAATFMYVLPSSFHSPKQDNIISVFYTIVTPALNPLIYSLRNKEVMRALRRVLGKYILLAHSTL

SEQ ID NO: 185 - protein, 316 aa, Artificial sequence
  synthetic
MELWNFTLGSGFILVGILNDSGSPELLCATITILYLLALISNGLLLLAITMEARLHMPMYLLLGQLSLMDLLFTSVVTPKALADFLRRENTISFGGCALQMFLALTMGGAEDLLLAFMAYDRYVAICHPLTYMTLMSSRACWLMVATSWILASLSALIYTVYTMHYPFCRAQEIRHLLCEIPHLLKVACADTSRYELMVYVMGVTFLIPSLAAILASYTQILLTVLHMPSNEGRKKALVTCSSHLTVVGMFYGAATFMYVLPSSFHSTRQDNIISVFYTIVTPALNPLIYSLRNKEVMRALRRVLGKYMLPAHSTL

SEQ ID NO: 186 - protein, 314 aa, Artificial sequence
  synthetic
MGDVNQSVASDFILVGLFSHSGSRQLLFSLVAVMFVIGLLGNTVLLFLIRVDSRLHTPMYFLLSQLSLFDIGCPMVTIPKMASDFLRGEGATSYGGGAAQIFFLTLMGVAEGVLLVLMSYDRYVAVCQPLQYPVLMRRQVCLLMMGSSWVVGVLNASIQTSITLHFPYCASRIVDHFFCEVPALLKLSCADTCAYEMALSTSGVLILMLPLSLIATSYGHVLQAVLSMRSEEARHKAVTTCSSHITVVGLFYGAAVFMYMVPCAYHSPQQDNVVSLFYSLVTPTLNPLIYSLRNPEVWMALVKVLSRAGLRQMC

SEQ ID NO: 187 - protein, 317 aa, Artificial sequence
  synthetic
MKSDNHSFLGDSPKAFILLGVSDRPWLELPLFVVLLLSYVLAMLGNVAIILASRVDPQLHSPMYIFLSHLSFLDLCYTTTTVPQMLVNMGSSQKTISYGGCTVQYAVFHWLGCTECIVLAAMALDRYVAICKPLHYAVLMHRALCQQLVALAWLSGFGNSFVQVVLTVQLPFCGRQVLNNFFCEVPAVIKLSCADTAVNDTILAVLVAFFVLVPLALILLSYGFIARAVLRIQSSKGRHKAFGTCSSHLMIVSLFYLPAIYMYLQPPSSYSQEQGKFISLFYSIITPTLNPFTYTLRNKDMKGALRRLLARIWRLCG

SEQ ID NO: 188 - protein, 320 aa, Artificial sequence
  synthetic
MMEIANVSSPEVFVLLGFSTRPSLETVLFIVVLSFYMVSILGNGIIILVSHTDVHLHTPMYFFLANLPFLDMSFTTSIVPQLLANLWGPQKTISYGGCVVQFYISHWLGATECVLLATMSYDRYAAICRPLHYTVIMHPQLCLGLALASWLGGLTTSMVGSTLTMLLPLCGNNCIDHFFCEMPLIMQLACVDTSLNEMEMYLASFVFVVLPLGLILVSYGHIARAVLKIRSAEGRRKAFNTCSSHVAVVSLFYGSIIFMYLQPAKSTSHEQGKFIALFYTVVTPALNPLIYTLRNTEVKSALRHMVLENCCGSAGKLAQI

SEQ ID NO: 189 - protein, 315 aa, Artificial sequence [sequence omitted]

SEQ ID NO: 190 - protein, 309 aa, Artificial sequence
  synthetic
MGLGNESSLMDFILLGFSDHPRLEAVLFVFVLFFYLLTLVGNFTIIIISYLDPPLHTPMYFFLSNLSLLDICFTTSLAPQTLVNLQRPKKTITYGGCVAQLYISLALGSTECILLADMALDRYIAVCKPLHYVVIMNPRLCQQLASISWLSGLASSLIHATFTLQLPLCGNHRLDHFICEVPALLKLACVDTTVNELVLFVVSVLFVVIPPALISISYGFITQAVLRIKSVEARHKAFSTCSSHLTVVIIFYGTIIYVYLQPSDSYAQDQGKFISLFYTMVTPTLNPIIYTLRNKDMKEALRKLLSGKL

SEQ ID NO: 191 - protein, 316 aa, Artificial sequence
  synthetic
MEETNNSSEKGFLLLGFSDQPQLERFLFAIILYFYVLSLLGNTALILVCCLDSRLHTPMYFFLSNLSCVDICFTTSVAPQLLVTMNKKDKTMSYGGCVAQLYVAMGLGSSECILLAVMAYDRYAAVCRPLRYIAIMHPRFCASLAGGAWLSGLITSLIQCSLTVQLPLCGHRTLDHIFCEVPVLIKLACVDTTFNEAELFVASVVFLIVPVLLILVSYGFITQAVLRIKSAAGRQKAFGTCSSHLVVVIIFYGTIIFMYLQPANRRSKNQGKFVSLFYTIVTPLLNPIIYTLRNKDVKGALRTLILGSAAGQSHKD

SEQ ID NO: 192 - protein, 357 aa, Artificial sequence
  synthetic
MNWVNKSVPQEFILLVFSDQPWLEIPPFVMFLFSYILTIFGNLTIILVSHVDFKLHTPMYFFLSNLSLLDLCYTTSTVPQMLVNICNTRKVISYGGCVAQLFIFLALGSTECLLLAVMCFDRFVAICRPLHYSIIMHQRLCFQLAAASWISGFSNSVLQSTWTLKMPLCGHKEVDHFFCEVPALLKLSCVDTTANEAELFFISVLFLLIPVTLILISYAFIVQAVLRIQSAEGQRKAFGTCGSHLIVVSLFYGTAISMYLQPPSPSSKDRGKMVSLFCGIIAPMLNPLIYTLRNKEVKEAFKRLVAKSLLNQEIRNMQMISFAKDTVLTYLTNFSASCPIFVITIENYCNLPQRKFP

SEQ ID NO: 193 - protein, 313 aa, Artificial sequence
  synthetic
MNWVNDSIIQEFILLGFSDRPWLEFPLLVVFLISYTVTIFGNLTIILVSRLDTKLHTPMYFFLTNLSLLDLCYTTCTVPQMLVNLCSIRKVISYRGCVAQLFIFLALGATEYLLLAVMSFDRFVAICRPLHYSVIMHQRLCLQLAAASWVTGFSNSVWLSTLTLQLPLCDPYVIDHFLCEVPALLKLSCVETTANEAELFLVSELFHLIPLTLILISYAFIVRAVLRIQSAEGRQKAFGTCGSHLIVVSLFYSTAVSVYLQPPSPSSKDQGKMVSLFYGIIAPMLNPLIYTLRNKEVKEGFKRLVARVFLIKK

SEQ ID NO: 194 - protein, 313 aa, Artificial sequence
  synthetic
MNWENESSPKEFILLGFSDRAWLQMPLFVVLLISYTITIFGNVSIMMVCILDPKLHTPMYFFLTNLSILDLCYTTTTVPHMLVNIGCNKKTISYAGCVAHLIIFLALGATECLLLAVMSFDRYVAVCRPLHYVVIMNYWFCLRMAAFSWLIGFGNSVLQSSLTLNMPRCGHQEVDHFFCEVPALLKLSCADTKPIEAELFFFSVLILLIPVTLILISYGFIAQAVLKIRSAEGRQKAFGTCGSHMIVVSLFYGTAIYMYLQPPSSTSKDWGKMVSLFYGIITSMLNSLIYSLRNKDMKEAFKRLMPRIFFCKK

SEQ ID NO: 195 - protein, 320 aa, Artificial sequence
  synthetic
MDQSNYSSLHGFILLGFSNHPKMEMILSGVVAIFYLITLVGNTAIILASLLDSQLHTPMYFFLRNLSFLDLCFTTSIIPQMLVNLWGPDKTISYVGCIIQLYVYMWLGSVECLLLAVMSYDRFTAICKPLHYFVVMNPHLCLKMIIMIWSISLANSVVLCTLTLNLPTCGNNILDHFLCELPALVKIACVDTTTVEMSVFALGIIIVLTPLILILISYGYIAKAVLRTKSKASQRKAMNTCGSHLTVVSMFYGTIIYMYLQPGNRASKDQGKFLTLFYTVITPSLNPLIYTLRNKDMKDALKKLMRFHHKSTKIKRNCKS

SEQ ID NO: 196 - protein, 312 aa, Artificial sequence
  synthetic
MDGVNDSSLQGFVLMGISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIACLGGLGNSVIQSTFTLQLPLCGHRRVEGFLCEVPAMIKLACGDTSLNQAVLNGVCTFFTAVPLSIIVISYCLIAQAVLKIRSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 197 - protein, 316 aa, Artificial sequence
  synthetic
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 198 - protein, 312 aa, Artificial sequence
  synthetic
MVNQSSTPGFLLLGFSEHPGLERTLFVVVFTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 199 - protein, 311 aa, Artificial sequence
  synthetic
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAVLRMQSTTGLQKVFGTCGAHLMAVSLFFIPAMCIYLQPPSGNSQDQGKFIALFYTVVTPSLNPLIYTLRNKVVRGAVKRLMGWE

SEQ ID NO: 200 - protein, 312 aa, Artificial sequence
  synthetic
MMIKKNASSEDFFILLGFSNWPQLEVVLFVVILIFYLMTLTGNLFIIILSYVDSHLHTPMYFFLSNLSFLDLCHTTSSIPQLLVNLRGPEKTISYAGCMVQLYFVLALGIAECVLLVVMSYDRYVAVCRPLHYTVLMHPRFCHLLAAASWVIGFTISALHSSFTFWVPLCGHRLVDHFFCEVPALLRLSCVDTHANELTLMVMSSIFVLIPLILILTAYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 201 - protein, 314 aa, Artificial sequence
  synthetic
MDGTNGSTQTHFILLGFSDRPHLERILFVVILIAYLLTLVGNTTIILVSRLDPHLHTPMYFFLAHLSFLDLSFTTSSIPQLLYNLNGCDKTISYMGCAIQLFLFLGLGGVECLLLAVMAYDRCVAICKPLHYMVIMNPRLCRGLVSVTWGCGVANSLAMSPVTLRLPRCGHHEVDHFLREMPALIRMACVSTVAIEGTVFVLAVGVVLSPLVFILLSYSYIVRAVLQIRSASGRQKAFGTCGSHLTVVSLFYGNIIYMYMQPGASSSQDQGMFLMLFYNIVTPLLNPLIYTLRNREVKGALGRLLLGKRELGKE

SEQ ID NO: 202 - protein, 311 aa, Artificial sequence
  synthetic
MGSFNTSFEDGFILVGFSDWPQLEPILFVFIFIFYSLTLFGNTIIIALSWLDLRLHTPMYFFLSHLSLLDLCFTTSTVPQLLINLCGVDRTITRGGCVAQLFIYLALGSTECVLLVVMAFDRYAAVCRPLHYMAIMHPHLCQTLAIASWGAGFVNSLIQTGLAMAMPLCGHRLNHFFCEMPVFLKLACADTEGTEAKMFVARVIVVAVPAALILGSYVHIAHAVLRVKSTAGRRKAFGTCGSHLLVVFLFYGSAIYTYLQSIHNYSEREGKFVALFYTIITPILNPLIYTLRNKDVKGALWKVLWRGRDSG

SEQ ID NO: 203 - protein, 317 aa, Artificial sequence
  synthetic
MEIDNQTWVREFILLGLSSDWCTQISLFSLFLVTYLMTVLGNCLIVLLIRLDSRLHTPMYFFLTNLSLVDVSYATSVVPQLLAHFLAEHKAIPFQSCAAQLFFSLALGGIEFVLLAVMAYDRHVAVSDRLRYSAIMHGGLCARLAITSWVSGSINSLVQTAITFQLPMCTNKFIDHISCELLAVVRLACVDTSSNEAAIMVSSIVLLMTPFCLVLLSYIRIISTILKIQSREGRKKAFHTCASHLTVVALCYGTTIFTYIQPHSGPSVLQEKLISVFYAIVMPLLNPVIYSLRNKEVKGAWHKLLEKFSGLTSKLGT

SEQ ID NO: 204 - protein, 317 aa, Artificial sequence
  synthetic
MGTDNQTWVSEFILLGLSSDWDTRVSLFVLFLVMYVVTVLGNCLIVLLIRLDSRLHTPMYFFLTNLSLVDVSYATSVVPQLLAHFLAEHKAIPFQSCAAQLFFSLALGGIEFVLLAVMAYDRYVAVCDALRYSAIMHGGLCARLAITSWVSGFISSPVQTAITFQLPMCRNKFIDHISCELLAVVRLACVDTSSNEVTIMVSSIVLLMTPFCLVLLSYIQIISTILKIQSREGRKKAFHTCASHLTVVALCYGVAIFTYIQPHSSPSVLQEKLFSVFYAILTPMLNPMIYSLRNKEVKGAWQKLLWKFSGLTSKLAT

SEQ ID NO: 205 - protein, 308 aa, Artificial sequence
  synthetic
MRQINQTQVTEFLLLGLSDGPHTEQLLFIVLLGVYLVTVLGNLLLISLVHVDSQLHTPMYFFLCNLSLADLCFSTNIVPQALVHLLSRKKVIAFTLCAARLLFFLIFGCTQCALLAVMSYDRYVAICNPLRYPNIMTWKVCVQLATGSWTSGILVSVVDTTFILRLPYRGSNSIAHFFCEAPALLILASTDTHASEMAIFLMGVVILLIPVFLILVSYGRIIVTVVKMKSTVGSLKAFSTCGSHLMVVILFYGSAIITYMTPKSSKQQEKSVSVFYAIVTPMLNPLIYSLRNKDVKAALRKVATRNFP

SEQ ID NO: 206 - protein, 314 aa, Artificial sequence
  synthetic
MGEENQTFVSKFIFLGLSQDLQTQILLFILFLIIYLLTVLGNQLIIILIFLDSRLHTPMYFFLRNLSFADLCFSTSIVPQVLVHFLVKRKTISFYGCMTQIIVFLLVGCTECALLAVMSYDRYVAVCKPLYYSTIMTQRVCLWLSFRSWASGALVSLVDTSFTFHLPYWGQNIINHYFCEPPALLKLASIDTYSTEMAIFSMGVVILLAPVSLILGSYWNIISTVIQMQSGEGRLKAFSTCGSHLIVVVLFYGSGIFTYMRPNSKTTKELDKMISVFYTAVTPMLNPIIYSLRNKDVKGALRKLVGRKCFSHRQ

SEQ ID NO: 207 - protein, 323 aa, Artificial sequence
  synthetic
MWQKNQTSLADFILEGLFDDSLTHLFLFSLTMVVFLIAVSGNTLTILLICIDPQLHTPMYFLLSQLSLMDLMHVSTIILKMATNYLSGKKSISFVGCATQHFLYLCLGGAECFLLAVMSYDRYVAICHPLRYAVLMNKKVGLMMAVMSWLGASVNSLIHMAILMHFPFCGPRKVYHFYCEFPAVVKLVCGDITVYETTVYISSILLLLPIFLISTSYVFILQSVIQMRSSGSKRNAFATCGSHLTVVSLWFGACIFSYMRPRSQCTLLQNKVGSVFYSIITPTLNSLIYTLRNKDVAKALRRVLRRDVITQCIQRLQLWLPRV

SEQ ID NO: 208 - protein, 319 aa, Artificial sequence
  synthetic
MEKANETSPVMGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 209 - protein, 316 aa, Artificial sequence
  synthetic
MQGENFTIWSIFFLEGFSQYPGLEVVLFVFSLVMYLTTLLGNSTLILITILDSRLKTPMYLFLGNLSFMDICYTSASVPTLLVNLLSSQKTIIFSGCAVQMYLSLAMGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLLYGVLTPMLNPIIYSLRNKEVKDAMKKLLGKITLHQTHEHL

SEQ ID NO: 210 - protein, 309 aa, Artificial sequence
  synthetic
MKNKTVLTEFILLGLTDVPELQVAVFTFLFLAYLLSILGNLTILILTLLDSHLQTPMYFFLRNFSFLEISFTNIFIPRVLISITTGNKSISFAGCFTQYFFAMFLGATEFYLLAAMSYDRYVAICKPLHYTTIMSSRICIQLIFCSWLGGLMAIIPTITLMSQQDFCASNRLNHYFCDYEPLLELSCSDTSLIEKVVFLVASVTLVVTLVLVILSYAFIIKTILKLPSAQQRTKAFSTCSSHMIVISLSYGSCMFMYINPSAKEGDTFNKGVALLITSVAPLLNPFIYTLRNQQVKQPFKDMVKKLLNL

SEQ ID NO: 211 - protein, 320 aa, Artificial sequence
  synthetic
MDATACNESVDGSPVFYLLGIPSLPETFFLPVFFIFLLFYLLILMGNALILVAVVAEPSLHKPMYFFLINLSTLDILFTTTTVPKMLSLFLLGDRFLSFSSCLLQMYLFQSFTCSEAFILVVMAYDRYVAICHPLHYPVLMNPQTNATLAASAWLTALLLPIPAVVRTSQMAYNSIAYIYHCFCDHLAVVQASCSDTTPQTLMGFCIAMVVSFLPLLLVLLSYVHILASVLRISSLEGRAKAFSTCSSHLLVVGTYYSSIAIAYVAYRADLPLDFHIMGNVVYAILTPILNPLIYTLRNRDVKAAITKIMSQDPGCDRSI

SEQ ID NO: 212 - protein, 320 aa, Artificial sequence
  synthetic
MGKDNASYLQAFILVGSSDRPGLEKILFAVILIFCILTLVGNTAIILLLVMDVRLHTPMYFFLGNLSFLDLCFTASIAPQLLWNLGGPEKTITYHGCVAQLYIYMMLGSTECVLLVVMSHDRYVAVCRSLHYMAVMRPHLCLQLVTVAWCCGFLNSFIMCPQTMQLSRCGRRRVDHFLCEMPALIAMSCEETMLVEAIHLCPGGGSPPGAALPHPHLLWRDCSRGAEDEVSSRAKESLPHLLFSPHSGLSLLRNHHLRVPEAGQQLLPRSGEVPDSLLHHRHSQHQPPHLHFEEQGCEGDHEETSGVGERGWGASTRGTL

SEQ ID NO: 213 - protein, 310 aa, Artificial sequence
  synthetic
MMENHSNVTEFILLGLTQSPELQLFLFVVFLLFYVATVLGNLLIVVTVTSDPHLHSPMYFLLANLSFIDICYSSVTAPKMIVDLLSERKTISFNGCMTQIFFLHFFGGAEMFLLVVMAYDRYVAICKPLHYLTIMNRRVCVLLVAVAWVGGFLHSIIQLAFIVQLPFCGPNVIDSFFCDLPPVLKLACTDTYVLGLLVIANSGLISLLCFLLLLISYVVILVSLRSHSSEGRSKALSTCTSHITVVILFFGPCIFIYTRPFTTFPMDKFVAVFYTVITPLLNPLIYTLRNKEMKAAMRKLWSRKVISSRK

SEQ ID NO: 214 - protein, 318 aa, Artificial sequence
  synthetic
MNPANHSQVAGFVLLGLSQVWELRFVFFTVFSAVYFMTVVGNLLIVVIVTSDPHLHTTMYFLLGNLSFLDFCYSSITAPRMLVDLLSGNPTISFGGCLTQLFFFHFIGGIKIFLLTVMAYDRYIAISQPLHYTLIMNQTVCALLMAASWVGGFIHSIVQIALTIQLPFCGPDKLDNFYCDVPQLIKLACTDTFVLELLMVSNNGLVTLMCFLVLLGSYTALLVMLRSHSREGRSKALSTCASHIAVVTLIFVPCIYVYTRPFRTFPMDKAVSVLYTIVTPMLNPAIYTLRNKEVIMAMKKLWRRKKDPIGPLEHRPLH

SEQ ID NO: 215 - protein, 311 aa, Artificial sequence
  synthetic
MEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLFGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 216 - protein, 314 aa, Artificial sequence
  synthetic
MKNKNNVTEFILLGLTQNPEGQKVLFVTFLLIYMVTIMGNLLIIVTIMASQSLGSPMYFFLASLSFIDTVYSTAFAPKMIVDLLSEKKTISFQGCMAQLFMDHLFAGAEVILLVVMAYDRYMAICKPLHELITMNRRVCVLMLLAAWIGGFLHSLVQFLFIYQLPFCGPNVIDNFLCDLYPLLKLACTNTYVTGLSMIANGGAICAVTFFTILLSYGVILHSLKTQSLEGKRKAFYTCASHVTVVILFFVPCIFLYARPNSTFPIDKSMTVVLTFITPMLNPLIYTLKNAEMKSAMRKLWSKKVSLAGKWLYHS

SEQ ID NO: 217 - protein, 309 aa, Artificial sequence
  synthetic
MEPRKNVTDFVLLGFTQNPKEQKVLFVMFLLFYILTMVGNLLIVVTVTVSETLGSPMYFFLAGLSFIDIIYSSSISPRLISGLFFGNNSISFQSCMAQLFIEHIFGGSEVFLLLVMAYDCYVAICKPLHYLVIMRQWVCVVLLVVSWVGGFLHSVFQLSIIYGLPFCGPNVIDHFFCDMYPLLKLVCTDTHAIGLLVVANGGLACTIVFLLLLISYGVILHSLKNLSQKGRQKALSTCSSHMTVVVFFFVPCIFMYARPARTFPIDKSVSVFYTVITPMLNPLIYTLRNSEMTSAMKKLWRRDLISSST

SEQ ID NO: 218 - protein, 309 aa, Artificial sequence
  synthetic
MANRNNVTEFILLGLTENPKMQKIIFVVFSVIYINAMIGNVLIVVTITASPSLRSPMYFFLAYLSFIDACYSSVNTPKLITDSLYENKTILFNGCMTQVFGEHFFRGVEVILLTVMAYDHYVAICKPLHYTTIMKQHVCSLLVGVSWVGGFLHATIQILFICQLPFCGPNVIDHFMCDLYTLINLACTNTHTLGLFIAANSGFICLLNCLLLLVSCVVILYSLKTHSLEARHEALSTCVSHITVVILSFIPCIFVYMRPPATLPIDKAVAVFYTMITSMLNPLIYTLRNAQMKNAIRKLCSRKAISSVK

SEQ ID NO: 219 - protein, 309 aa, Artificial sequence
  synthetic
MENRNNMTEFVLLGLTENPKMQKIIFVVFFVIYIITVVGYVLIVVTITASPSLGSPMYLSLAYLSFIDACYSSVNTPNLITHSLYGKKAILFNGCMTQVFGEHFFGGAEGILLTVMAYDHYVAICKPLHYMTIMNQCVCALLMGVVWMGGFLHATIQILFIFQLPFCGPNVIDHFMCDLNPLLNLACTDTHMLELFIAANSGFICLLNFALLLVSYVVILCSLRTHSLEARHKALSTCVSHITVVILFFVPCIFVYMRPAATLPIDKAVAIFYTMITPMLNPLIYTLKNAQMKNAIRKLCSRKDISGDK

SEQ ID NO: 220 - protein, 309 aa, Artificial sequence
  synthetic
MEKKKNVTEFILIGLTQNPIMEKVTFVVFLVLYMITLSGNLLIVVTITTSQALSSPMYFFLTHLSLIDTVYSSSSAPKLIVDSFQEKKIISFNGCMAQAYAEHIFGATEIILLTVMACDCYVAICKPLNYTTIMSHSLCILLVAVAWVGGFLHATIQILFTVWLPFCGPNVIGHFMCDLYPLLKLVCIDTHTLGLFVAVNSGFICLLNFLILVVSYVIILRSLKNNSLEGRCKALSTCISHIIVVVLFFVPCIFVYLRSVTTLPIDKAVAVFYTMVVPMLNPVVYTLRNAEVKSAIRKLWRKKVTSDND

SEQ ID NO: 221 - protein, 302 aa, Artificial sequence
  synthetic
MDIPQNITEFFMLGLSQNSEVQRVLFVVFLLIYVVTVCGNMLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 222 - protein, 316 aa, Artificial sequence
  synthetic
MQNQSFVTEFVLLGLSQNPNVQEIVFVVFLFVYIATVGGNMLIVVTILSSPALLVSPMYFFLGFLSFLDACFSSVITPKMIVDSLYVTKTISFEGCMMQLFAEHFFAGVEVIVLTAMAYDRYVAICKPLHYSSIMNRRLCGILMGVAWTGGLLHSMIQILFTFQLPFCGPNVINHFMCDLYPLLELACTDTHIFGLMVVINSGFICIINFSLLLVSYAVILLSLRTHSSEGRWKALSTCGSHIAVVILFFVPCIFVYTRPPSAFSLDKMAAIFYIILNPLLNPLIYTFRNKEVKQAMRRIWNRLMVVSDEKENIKL

SEQ ID NO: 223 - protein, 309 aa, Artificial sequence
  synthetic
MASTSNVTELIFTGLFQDPAVQSVCFVVFLPVYLATVVGNGLIVLTVSISKSLDSPMYFFLSCLSLVEISYSSTIAPKFIIDLLAKIKTISLEGCLTQIFFFHFFGVAEILLIVVMAYDCYVAICKPLHYMNIISRQLCHLLVAGSWLGGFCHSIIQILVIIQLPFCGPNVIDHYFCDLQPLFKLACTDTFMEGVIVLANSGLFSVFSFLILVSSYIVILVNLRNHSAEGRHKALSTCASHITVVILFFGPAIFLYMRPSSTFTEDKLVAVFYTVITPMLNPIIYTLRNAEVKIAIRRLWSKKENPGRE

SEQ ID NO: 224 - protein, 315 aa, Artificial sequence
  synthetic
MRQNNNITEFVLLGFSQDPGVQKALFVMFLLTYLVTVVGNLLIVVDIIASPSLGSPMYFFLACLSFIDAAYSTTISPKLIVGLFCDKKTISFQGCMGQLFIDHFFGGAEVFLLVVMACDRYVAICKPLHYLTIMNRQVCFLLLVVAMIGGFVHSAFQIVVYSLPFCGPNVIVHFSCDMHPLLELACTDTYFIGLTVVVNSGAICMVIFNLLLISYGVILSSLKTYSQEKRGKALSTCSSGSTVVVLFFVPCIFIYVRPVSNFPTDKFMTVFYTIITHMLSPLIYTLRNSEMRNAIEKLLGKKLTIFIIGGVSVLM

SEQ ID NO: 225 - protein, 328 aa, Artificial sequence
  synthetic
MRPSSNVTEFVLLGLTQDPDVKKTLFVMFLLIYIVTMVGNLLIWVTTIGSPSLGSLMYFFLAYLSLMDAIYSTAMSPKLMIDLLCDKIAISLSACMGQLFIEHLLGGAEVFLLVVMAYDRYVAISKPLHYLNIMNRLVCILLLVVAMIGGFVHSVVQIVFLYSLPICGPNVIDHSVCDMYPLLELLCLDTYFIGLTVVANGGIICMVIFTFLLISCGVILNFLKTYSQEERHKALPTCISHIIVVALVFVPCIFMYVRPVSNFPFDKLMTVFYSIITLMLNPLIYSLRQSEMKNAMKNLWCEKLSIVRKRVSPTLNIFIPSSKATNRR

SEQ ID NO: 226 - protein, 326 aa, Artificial sequence
  synthetic
MYVSNCNPCAIHRKINYPNTKLDFEQVNNITEFILLGLTQNAEAQKLLFAVFTLIYFLTMVDNLIIVVTITTSPALDSPVYFFLSFFSFIDGCSSSTMAPKMIFDLLTEKKTISFSGCMTQLFVEHFFGGVEIILLVVMAYDCYVAICKPLYYLITMNRQVCGLLVAMAWVGGFLHALIQMLLIVWLPFCGPNVIDHFICDLFPLLKLSCTDTHVFGLFVAANSGLMCMLIFSILITSYVLILCSQRKALSTCAFHITVVVLFFVPCILVYLRPMITFPIDKAVSVFYTVVTPMLNPLIYTLRNTEVKNAMKQLWSQIIWGNNLCD

SEQ ID NO: 227 - protein, 309 aa, Artificial sequence
  synthetic
MENQNNVTEFILLGLTENLELWKIFSAVFLVMYVATVLENLLIVVTIITSQSLRSPMYFFLTFLSLLDVMFSSVVAPKVIVDTLSKSTTISLKGCLTQLFVEHFFGGVGIILLTVMAYDRYVAICKPLHYTIIMSPRVCCLMVGGAWVGGFMHAMIQLLFMYQIPFCGPNIIDHFICDLFQLLTLACTDTHILGLLVTLNSGMMCVAIFLILIASYTVILCSLKSYSSKGRHKALSTCSSHLTVVVLFFVPCIFLYMRPVVTHPIDKAMAVSDSIITPMLNPLIYTLRNAEVKSAMKKLWMKWEALAGK

SEQ ID NO: 228 - protein, 310 aa, Artificial sequence
  synthetic
MQLNNNVTEFILLGLTQDPFWKKIVFVIFLRLYLGTLLGNLLIIISVKTSQALKNPMFFFLFYLSLSDTCLSTSITPRMIVDALLKKTTISFSECMIQVFSSHVFGCLEIFILILTAVDRYVDICKPLHYMTIISQWVCGVLMAVAWVGSCVHSLVQIFLALSLPFCGPNVINHCFCDLQPLLKQACSETYVVNLLLVSNSGAICAVSYVMLIFSYVIFLHSLRNHSAEVIKKALSTCVSHIIVVILFFGPCIFMYTCLATVFPMDKMIAVFYTVGTSFLNPVIYTLKNTEVKSAMRKLWSKKLITDDKR

SEQ ID NO: 229 - protein, 310 aa, Artificial sequence
  synthetic
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTLRNAEVKNAMRKLWHGKIISENKG

SEQ ID NO: 230 - protein, 306 aa, Artificial sequence
  synthetic
MNNVTEFILLGLTHNPELQKFLFVMFLITYLITLAGNLLISVIIFISPALGSPMYLFLSYLSIIDIFYSSSIAPKMIFDLISENNTISFNGCMTQLFTEHFFAAAETILLSVMAYDCYVAICKPLHYATIMTQSMCGFLMVVAGILGFVHGGIQTLFIAQLPFCGPNVIDHFMCDLVPLLELACTDTHTLGPLIAANSGSLCFLIFSILDASYVIILCSLRSHSSEGHLKALSSCASHIFTVILFFVPCSYLYLRPLTSFPTDKAVTVFCTLFTPMLNPLIYTVKNKAVKNVIKKLWKQIMTTDDK

SEQ ID NO: 231 - protein, 303 aa, Artificial sequence
  synthetic
MTEFIFLVLSPNQEVQRVCFVIFLFLYTAIVLGNFLIVLTVMTSRSLGSPMYFFLSYLSFMEICYSSATAPKLISDLLAERKVISWWGCMAQLFFLHFFGGTEIFLLTVMAYDHYVAICKPLSYTTIMNWQVCTVLVGIAWVGGFMHSFAQILLIFHLLFCGPNVINHYFCDLVPLLKLACSDTFLIGLLIVANGGTLSVISFGVLLASYMVILLHLRTWSSEGWCKALSTCGSHFAVVILFFGPCVFNSLRPSTTLPIDKMVAVFYTVITAILNPVIYSLRNAEMRKAMKRLWIRTLRLNEK

SEQ ID NO: 232 - protein, 305 aa, Artificial sequence
  synthetic
MVATNNVTEIIFVGFSQNWSEQRVISVMFLLMYTAVVLGNGLIVVTILASKVLTSPMYFFLSYLSFVEICYCSVMAPKLIFDSFIKRKVISLKGCLTQMFSLHFFGGTEAFLLMVMAYDRYVAICKPLHYMAIMNQRMCGLLVRIAWGGGLLHSVGQTFLIFQLPFCGPNIMDHYFCDVHPVLELACADTFFISLLIITNGGSISVVSFFVLMASYLIILHFLRSHNLEGQHKALSTCASHVTVVDLFFIPCSLVYIRPCVTLPADKIVAVFYTVVTPLLNPVIYSFRNAEVKNAMRRFIGGKVI

SEQ ID NO: 233 - protein, 313 aa, Artificial sequence
  synthetic
MKKEQDSNVTEFVLLGLSSSWELQLFLFLLFLFFYIAIVLGNLLIVVTVQAHAHLLQSPMYYFLGHLSFIDLCLSCVTVPKMLGDFLQQGKSISFSGCLAQIYFLHFLGASEMFLLTVMAYDRYVAICNPLRYLTVMNPQLCLWLVLACWCGGFIHSIMQVILVIQLPFCGPNELDNFYCDVPQVIKLACMDTYVVEVLVIANSGLLSLVCFLVLLFSYAIILITLRTHFCQGQNKVFSTCASHLTVVSLIFVPCVFIYLRPFCSFSVDKIFSLFYTVITPMLNPLIYTLRNTDMKTAMKKLRIKPCGIPLPC

SEQ ID NO: 234 - protein, 314 aa, Artificial sequence
  synthetic
MDQINHTNVKEFFFLELTRSRELEFFLFVVFFAVYVATVLGNALIVVTITCESRLHTPMYFLLRNKSVLDIVFSSITVPKFLVDLLSDRKTISYNDCMAQIFFFHFAGGADIFFLSVMAYDRYLAIAKPLHYVTMMRKEVWVALVVASWVSGGLHSIIQVILMLPFPFCGPNTLDAFYCYVLQVVKLACTDTFALELFMISNNGLVTLLWFLLLLGSYTVILVMLRSHSGEGRNKALSTCTSHMLVVTLHFVPCVYIYCRPFMTLPMDTTISINNTVITPMLNPIIYSLRNQEMKSAMQRLQRRLGPSESRKWG

SEQ ID NO: 235 - protein, 311 aa, Artificial sequence
  synthetic
MEMENCTRVKEFIFLGLTQNREVSLVLFLFLLLVYVTTLLGNLLIMVTVTCESRLHTPMYFLLHNLSIADICFSSITVPKVLVDLLSERKTISFNHCFTQMFLFHLIGGVDVFSLSVMALDRYVAISKPLHYATIMSRDHCIGLTVAAWLGGFVHSIVQISLLLPLPFCGPNVLDTFYCDVHRVLKLAHTDIFILELLMISNNGLLTTLWFFLLLVSYIVILSLPKSQAGEGRRKAISTCTSHITVVTLHFVPCIYVYARPFTALPMDKAISVTFTVISPLLNPLIYTLRNHEMKSAMRRLKRRLVPSDRK

SEQ ID NO: 236 - protein, 311 aa, Artificial sequence
  synthetic
MELGNVTRVKEFIFLGLTQSQDQSLVLFLFLCLVYMTTLLGNLLIMVTVTCESRLHTPMYFLLRNLAILDICFSSTTAPKVLLDLLSKKKTISYTSCMTQIFLFHLLGGADIFSLSVMAFDCYMAISKPLHYVTIMSRGQCTALISASWMGGFVHSIVQISLLLPLPFCGPNVLDTFYCDVPQVLKLTCTDTFALEFLMISNNGLVTTLWFIFLLVSYTVILMTLRSQAGGGRRKAISTCTSHITVVTLHFVPCIYVYARPFTALPTEKAISVTFTVISPLLNPLIYTLRNQEMKSAMRRLKRRLVPSERE

SEQ ID NO: 237 - protein, 314 aa, Artificial sequence
  synthetic
MDQRNYTRVKEFTFLGITQSRELSQVLFTFLFLVYMTTLMGNFLIMVTVTCESHLHTPMYFLLRNLSILDICFSSITAPKVLIDLLSETKTISFSGCVTQMFFFHLLGGADVFSLSVMAFDRYIAISKPLHYMTIMSRGRCTGLIVASWVGGFVHSIAQISLLLPLPFCGPNVLDTFYCDVPQVLKLACTDTFTLELLMISNNGLVSWFVFFFLLISYTVILMMLRSHTGEGRRKAISTCTSHITVVTLHFVPCIYVYARPFTALPTDTAISVTFTVISPLLNPIIYTLRNQEMKLAMRKLKRRLGQSERILIQ

SEQ ID NO: 238 - protein, 310 aa, Artificial sequence
  synthetic
MEPQNTTQVSMFVLLGFSQTQELQKFLFLLFLLVYVTTIVGNLLIMVTVTFDCRLHTPMYFLLRNLALIDLCYSTVTSPKMLVDFLHETKTISYQGCMAQIFFFHLLGGGTVFFLSVMAYDRYIAISQPLRYVTIMNTQLCVGLVVAAWVGGFVHSIVQLALILPLPFCGPNILDNFYCDVPQVLRLACTDTSLLEFLMISNSGLLVIIWFLLLLISYTVILVMLRSHSGKARRKAASTCTTHIIVVSMIFIPCIYIYTWPFTPFLMDKAVSISYTVMTPMLNPMIYTLRNQDMKAAMRRLGKCLVICRE

SEQ ID NO: 239 - protein, 307 aa, Artificial sequence
  synthetic
METGNLTWVSDFVFLGLSQTRELQRFLFLMFLFVYITTVMGNILIIITVTSDSQLHTPMYFLLRNLAVLDLCFSSVTAPKMLVDLLSEKKTISYQGCMGQIFFFHFLGGAMVFFLSVMAFDRLIAISRPLRYVTVMNTQLWVGLVVATWVGGFVHSIVQLALMLPLPFCGPNILDNFYCDVPQVLRLACTDTSLLEFLKISNSGLLDVVWFFLLLMSYLFILVMLRSHPGEARRKAASTCTTHIIVVSMIFVPSIYLYARPFTPFPMDKLVSIGHTVMTPMLNPMIYTLRNQDMQAAVRRLGRHRLV

SEQ ID NO: 240 - protein, 305 aa, Artificial sequence
  synthetic
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVTWGIGFLHSVSQLAFAVHLLFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 241 - protein, 305 aa, Artificial sequence
  synthetic
MVTEFIFLGLSDSQGLQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 242 - protein, 305 aa, Artificial sequence
  synthetic
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHCPLDKSSKALSTLTAHITVVLLFFGPCVFIYAWPFPIKSLDKFLAVFYSVITPLLNPIIYTLRNKDMKTAIRRLRKWDAHSSVKF

SEQ ID NO: 243 - protein, 314 aa, Artificial sequence
  synthetic
MDVGNKSTMSEFVLLGLSNSWELQMFFFMVFSLLYVATMVGNSLIVITVIVDPHLHSPMYFLLTNLSIIDMSLASFATPKMITDYLTGHKTISFDGCLTQIFFLHLFTGTEIILLMAMSFDRYIAICKPLHYASVISPQVCVALVVASWIMGVMHSMSQVIFALTLPFCGPYEVDSFFCDLPVVFQLACVDTYVLGLFMISTSGIIALSCFIVLFNSYVIVLVTVKHHSSRGSSKALSTCTAHFIVVFLFFGPCIFIYMWPLSSFLTDKILSVFYTIFTPTLNPIIYTLRNQEVKIAMRKLKNRFLNFNKAMPS

SEQ ID NO: 244 - protein, 323 aa, Artificial sequence
  synthetic
MDKSNSSVVSEFVLLGLCSSQKLQLFYFCFFSVLYTVIVLGNLLIILTVTSDTSLHSPMYFLLGNLSFVDICQASFATPKMIADFLSAHETISFSGCIAQIFFIHLFTGGEMVLLVSMAYDRYVAICKPLYYVVIMSRRTCTVLVMISWAVSLVHTLSQLSFTVNLPFCGPNVVDSFFCDLPRVTKLACLDSYIIEILIVVNSGILSLSTFSLLVSSYIIILVTVWLKSSAAMAKAFSTLASHIAVVILFFGPCIFIYVWPFTISPLDKFLAIFYTVFTPVLNPIIYTLRNRDMKAAVRKIVNHYLRPRRISEMSLVVRTSFH

SEQ ID NO: 245 - protein, 324 aa, Artificial sequence
  synthetic
MNETNHSRVTEFVLLGLSSSRELQPFLFLTFSLLYLAILLGNFLIILTVTSDSRLHTPMYFLLANLSFIDVCVASFATPKMIADFLVERKTISFDACLAQIFFVHLFTGSEMVLLVSMAYDRYVAICKPLHYMTVMSRRVCVVLVLISWFVGFIHTTSQLAFTVNLPFCGPNKVDSFFCDLPLVTKLACIDTYVVSLLIVADSGFLSLSSFLLLVVSYTVILVTVRNRSSASMAKARSTLTAHITVVTLFFGPCIFIYVWPFSSYSVDKVLAVFYTIFTLILNPVIYTLRNKEVKAAMSKLKSRYLKPSQVSVVIRNVLFLETK

SEQ ID NO: 246 - protein, 304 aa, Artificial sequence
  synthetic
MERANHSVVSEFILLGLSKSQNLQILFFLGFSVVFVGIVLGNLLILVTVTFDSLLHTPMYFLLSNLSCIDMILASFATPKMIVDFLRERKTISWWGCYSQMFFMHLLGGSEMMLLVAMAIDRYVAICKPLHYMTIMSPRVLTGLLLSSYAVGFVHSSSQMAFMLTLPFCGPNVIDSFFCDLPLVIKLACKDTYILQLLVIADSGLLSLVCFLLLLVSYGVIIFSVRYRAASRSSKAFSTLSAHITVVTLFFAPCVFIYVWPFSRYSVDKILSVFYTIFTPLLNPIIYTLRNQEVKAAIKKRLCI

SEQ ID NO: 247 - protein, 310 aa, Artificial sequence
  synthetic
MDPQNYSLVSEFVLHGLCTSRHLQNFFFIFFFGVYVAIMLGNLLILVTVISDPCLHSSPMYFLLGNLAFLDMWLASFATPKMIRDFLSDQKLISFGGCMAQIFFLHFTGGAEMVLLVSMAYDRYVAICKPLHYMTLMSWQTCIRLVLASWVVGFVHSISQVAFTVNLPYCGPNEVDSFFCDLPLVIKLACMDTYVLGIIMISDSGLLSLSCFLLLLISYTVILLAIRQRAAGSTSKALSTCSAHIMVVTLFFGPCIFVYVRPFSRFSVDKLLSVFYTIFTPLLNPIIYTLRNEEMKAAMKKLQNRRVTFQ

SEQ ID NO: 248 - protein, 311 aa, Artificial sequence
  synthetic
MAHTNESMVSEFVLLGLSNSWGLQLFFFAIFSIVYVTSVLGNVLIIVIISFDSHLNSPMYFLLSNLSFIDICQSNFATPKMLVDFFIERKTISFEGCMAQIFVLHSFVGSEMMLLVAMAYDRFIAICKPLHYSTIMNRRLCVIFVSISWAVGVLHSVSHLAFTVDLPFCGPNEVDSFFCDLPLVIELACMDTYEMEIMTLTNSGLISLSCFLALIISYTIILIGVRCRSSSGSSKALSTLTAHITVVILFFGPCIYFYIWPFSRLPVDKFLSVFYTVCTPLLNPIIYSLRNEDVKAAMWKLRNRHVNSWKN

SEQ ID NO: 249 - protein, 312 aa, Artificial sequence
  synthetic
MKLLNQSQVSEFILLGLTSSQDVEFLLFALFSVIYVVTVLGNLLIIVTVFNTPNLNTPMYFLLGNLSFVDMTLASFATPKVILNLLKKQKVISFAGCFTQIFLLHLLGGVEMVLLVSMAFDRYVAICKPLHYMTIMNKKVCVLLVVTSWLLGLLHSGFQIPFAVNLPFCGPNVVDSIFCDLPLVTKLACIDIYFVQVVIVANSGIISLSCFIILLISYSLILITIKNHSPTGQSKARSTLTAHITVVILFFGPCIFIYIWPFGNHSVDKFLAVFYTIITPILNPIIYTLRNKEMKISMKKLWRAFVNSREDT

SEQ ID NO: 250 - protein, 312 aa, Artificial sequence
  synthetic
MDLKNGSLVTEFILLGFFGRWELQIFFFVTFSLIYGATVMGNILIMVTVTCRSTLHSPLYFLLGNLSFLDMCLSTATTPKMIIDLLTDHKTISVWGCVTQMFFMHFFGGAEMTLLIIMAFDRYVAICKPLHYRTIMSHKLLKGFAILSWIIGFLHSISQIVLTMNLPFCGHNVINNIFCDLPLVIKLACIETYTLELFVIADSGLLSFTCFILLLVSYIVILVSVPKKSSHGLSKALSTLSAHIIVVTLFFGPCIFIYVWPFSSLASNKTLAVFYTVITPLLNPSIYTLRNKKMQEAIRKLRFQYVSSAQNF

SEQ ID NO: 251 - protein, 312 aa, Artificial sequence
  synthetic
MDGENHSVVSEFLFLGLTHSWEIQLLLLVFSSVLYVASITGNILIVFSVTTDPHLHSPMYFLLASLSFIDLGACSVTSPKMIYDLFRKRKVISFGGCIAQIFFIHVVGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKRIS

SEQ ID NO: 252 - protein, 312 aa, Artificial sequence; identical to SEQ ID NO: 251
  synthetic

SEQ ID NO: 253 - protein, 312 aa, Artificial sequence; identical to SEQ ID NO: 251
  synthetic

SEQ ID NO: 254 - protein, 312 aa, Artificial sequence
  synthetic
MDGENHSVVSEFLFLGLTHSWEIQLLLLVFSSVLYVASITGNIFIVFSVTTDPHLHSPMYFLLASLSFIDLGACSVTSPKMIYDLFRKRKVISFGGCIAQIFFIHVIGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKKIS

SEQ ID NO: 255 - protein, 312 aa, Artificial sequence
  synthetic
MNGMNHSVVSEFVFMGLTNSREIQLLLFVFSLLFYFASMMGNLVIVFTVTMDAHLHSPMYFLLANLSIIDMAFCSITAPKMICDIFKKHKAISFRGCITQIFFSHALGGTEMVLLIAMAFDRYMAICKPLHYLTIMSPRMCLYFLATSSIIGLIHSLVQLVFVVDLPFCGPNIFDSFYCDLPRLLRLACTNTQELEFMVTVNSGLISVGSFVLLVISYIFILFTVWKHSSGGLAKALSTLSAHVTVVILFFGPLMFFYTWPSPTSHLDKYLAIFDAFITPFLNPVIYTFRNKDMKVAMRRLCSRLAHFTKIL

SEQ ID NO: 256 - protein, 312 aa, Artificial sequence
  synthetic
MDEANHSVVSEFVFLGLSDSRKIQLLLFLFFSVFYVSSLMGNLLIVLTVTSDPRLQSPMYFLLANLSIINLVFCSSTAPKMIYDLFRKHKTISFGGCVVQIFFIHAVGGTEMVLLIAMAFDRYVAICKPLHYLTIMNPQRCILFLVISWIIGIIHSVIQLAFVVDLLFCGPNELDSFFCDLPRFIKLACIETYTLGFMVTANSGFISLASFLILIISYIFILVTVQKKSSGGIFKAFSMLSAHVIVVVLVFGPLIFFYIFPFPTSHLDKFLAIFDAVITPVLNPVIYTFRNKEMMVAMRRRCSQFVNYSKIF

SEQ ID NO: 257 - protein, 313 aa, Artificial sequence
  synthetic
MDSLNQTRVTEFVFLGLTDNRVLEMLFFMAFSAIYMLTLSGNILIIIATVFTPSLHTPMYFFLSNLSFIDICHSSVTVPKMLEGLLLERKTISFDNCITQLFFLHLFACAEIFLLIIVAYDRYVAICTPLHYPNVMNMRVCIQLVFALWLGGTVHSLGQTFLTIRLPYCGPNIIDSYFCDVPLVIKLACTDTYLTGILIVTNSGTISLSCFLAVVTSYMVILVSLRKHSAEGRQKALSTCSAHFMVVALFFGPCIFIYTRPDTSFSIDKVVSVFYTVVTPLLNPFIYTLRNEEVKSAMKQLRQRQVFFTKSYT

SEQ ID NO: 258 - protein, 313 aa, Artificial sequence
  synthetic
METANYTKVTEFVLTGLSQTREVQLVLFVIFLSFYLFILPGNILIICTIRLDPHLTSPMYFLLANLALLDIWYSSITAPKMLIDFFVERKIISFGGCIAQLFFLHFVGASEMFLLTVMAYDRYAAICRPLHYATIMNRRLCCILVALSWMGGFIHSIIQVALIVRLPFCGPNELDSYFCDITQVVRIACANTFPEELVMICSSGLISVVCFIALLMSYAFLLALLKKHSGSGENTNRAMSTCYSHITIVVLMFGPSIYIYARPFDSFSLDKVVSVFHTVIFPLLNPIIYTLRNKEVKAAMRKVVTKYILCEEK

SEQ ID NO: 259 - protein, 313 aa, Artificial sequence
  synthetic
METANYTKVTEFVLTGLSQTPEVQLVLFVIFLSFYLFILPGNILIICTISLDPHLTSPMYFLLANLAFLDIWYSSITAPEMLIDFFVERKIISFDGCIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALFKKLSGSGENTNRAMSTCYSHITIVVLMFGPSIYIYARPFDSFSLDKVVSVFNTLIFPLRNPIIYTLRNKEVKAAMRKLVTKYILCKEK

SEQ ID NO: 260 - protein, 307 aa, Artificial sequence
  synthetic
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMMLALWLGGFVHSIIQVVLILRLPFCGPNQLDNFFCDVPQVIKLACTDTFVVELLMVFNSGLMTLLCFLGLLASYAVILCRIRGSSSEAKNKAMSTCITHIIVIFFMFGPGIFIYTRPFRAFPADKVVSLFHTVIFPLLNPVIYTLRNQEVKASMKKVFNKHIA

SEQ ID NO: 261 - protein, 316 aa, Artificial sequence
  synthetic
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 262 - protein, 308 aa, Artificial sequence
  synthetic
METQNLTVVTEFILLGLTQSQDAQLLVFVLVLIFYLIILPGNFLIIFTIKSDPGLTAPLYFFLGNLALLDASYSFIVVPRMLVDFLSEKKVISYRSCITQLFFLHFLGAGEMFLLVVMAFDRYIAICRPLHYSTIMNPRACYALSLVLWLGGFIHSIVQVALILHLPFCGPNQLDNFFCDVPQVIKLACTNTFVVELLMVSNSGLLSLLCFLGLLASYAVILCRIREHSSEGKSKAISTCTTHIIIIFLMFGPAIFIYTCPFQAFPADKVVSLFHTVIFPLMNPVIYTLRNQEVKASMRKLLSQHMFC

SEQ ID NO: 263 - protein, 309 aa, Artificial sequence
  synthetic
MGAKNNVTEFVLFGLFESREMQHTCFVVFFLFHVLTVLGNLLVIITINARKTLKSPMYFFLSQLSFADICYPSTTIPKMIADTFVEHKIISFNGCMTQLFSAHFFGGTEIFLLTAMAYDRYVAICRPLHYTAIMDCRKCGLLAGASWLAGFLHSILQTLLTVQLPFCGPNEIDNFFCDVHPLLKLACADTYMVGLIVVANSGMISLASFFILIISYVIILLNLRSQSSEDRRKAVSTCGSHVITVLLVLMPPMFMYIRPSTTLAADKLIILFNIVMPPLLNPLIYTLRNNDVKNAMRKLFRVKRSLGEK

SEQ ID NO: 264 - protein, 319 aa, Artificial sequence
  synthetic
MFYLHWTMEKSNNSTLFILLGFSQNKNIEVLCFVLFLFCYIAIWMGNLLIMISITCTQLIHQPMYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKVWCCQILLKRNQLF

SEQ ID NO: 265 - protein, 310 aa, Artificial sequence
  synthetic
MEENHTEVTEFILLGLTDDPELQVPLFLVFLAIYLITLVGNLGMIVLIRIDSHLHTPMYFFLSNLSFVDACYSSAVTPKMLVNFLSEDKTISFSGCAVQFFFFCTFVTTECFLLAAMAYDRYVAICNPLLYTVIMSKRVCIRLVTGSYVAGFLNALIHTGLTFRLSFCGSNEINHFFCDIPPLLKLSCSDTSINELLLFIFAGFIQIFTILIILISYLFILITILKMRSAEGRRKAFSTCASHLTAVTLFYGTLLFMYLRPSSSYSLDQDKVASVFYTVVIPMLNPLIYSLRNKDVKEALKKVLKKKKFS

SEQ ID NO: 266 - protein, 309 aa, Artificial sequence
  synthetic
MENSTEVTEFILLGLTDDPNLQIPLLLAFLFIYLITLLGNGGMMVIIHSDSHLHTPMYFFLSNLSLVDLGYSSAVAPKTVAALRSGDKAISYDGCAAQFFFFVGFATVECYLLASMAYDRHAAVCRPLHYTTTMTAGVCALLATGSYVSGFLNASIHAAGTFRLSFCGSNEINHFFCDIPPLLALSCSDTRISKLVVFVAGFNVFFTLLVILISYFFICITIQRMHSAEGQKKVFSTCASHLTALSIFYGTIIFMYLQPNSSQSVDTDKIASVFYTVVIPMLNPLIYSLRNKEVKSALWKILNKLYPQY

SEQ ID NO: 267 - protein, 314 aa, Artificial sequence
  synthetic
MENNTEVSEFILLGLTNAPELQVPLFIMFTLIYLITLTGNLGMIILILLDSHLHTPMYFFLSNLSLAGIGYSSAVTPKVLTGLLIEDKAISYSACAAQMFFCAVFATVENYLLSSMAYDRYAAVCNPLHYTTTMTTRVCACLAIGCYVIGFLNASIQIGDTFRLSFCMSNVIHHFFCDKPAVITLTCSEKHISELILVLISSFNVFFALLVTLISYLFILITILKRHTGKGYQKPLSTCGSHLIAIFLFYITVIIMYIRPSSSHSMDTDKIASVFYTMIIPMLSPIVYTLRNKDVKNAFMKVVEKAKYSLDSVF

SEQ ID NO: 268 - protein, 314 aa, Artificial sequence
  synthetic
MENKTEVTQFILLGLTNDSELQVPLFITFPFIYIITLVGNLGIIVLIFWDSCLHNPMYFFLSNLSLVDFCYSSAVTPIVMAGFLIEDKVISYNACAAQMYIFVAFATVENYLLASMAYDRYAAVCKPLHYTTTMTTTVCARLAIGSYLCGFLNASIHTGDTFSLSFCKSNEVHHFFCDIPAVMVLSCSDRHISELVLIYVVSFNIFIALLVILISYTFIFITILKMHSASVYQKPLSTCASHFIAVGIFYGTIIFMYLQPSSSHSMDTDKMAPVFYTMVIPMLNPLVYSLRNKEVKSAFKKVVEKAKLSVGWSV

SEQ ID NO: 269 - protein, 309 aa, Artificial sequence
  synthetic
MENCTEVTKFILLGLTSVPELQIPLFILFTFIYLLTLCGNLGMMLLILMDSCLHTPMYFFLSNLSLVDFGYSSAVTPKVMAGFLRGDKVISYNACAVQMFFFVALATVENYLLASMAYDRYAAVCKPLHYTTTMTASVGACLALGSYVCGFLNASFHIGGIFSLSFCKSNLVHHFFCDVPAVMALSCSDKHTSEVILVFMSSFNIFFVLLVIFISYLFIFITILKMHSAKGHQKALSTCASHFTAVSVFYGTVIFIYLQPSSSHSMDTDKMASVFYAMIIPMLNPVVYSLRNREVQNAFKKVLRRQKFL

SEQ ID NO: 270 - protein, 314 aa, Artificial sequence
  synthetic
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCASHLTAVSIFYGTGIFMYLRPNSSHFMGTDKMASVFYAIVIPMLNPLVYSLRNKEVKSAFKKTVGKAKASIGFIF

SEQ ID NO: 271 - protein, 317 aa, Artificial sequence
  synthetic
MMRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 272 - protein, 310 aa, Artificial sequence
  synthetic
MDKENSSMVTEFIFMGITQDPQMEIIFFVVFLIVYLVNVVGNIGMIILITTDTQLHTPMYFFLCNLSFVDLGYSSAIAPRMLADFLTNHKVISFSSCATQFAFFVGFVDAECYVLAAMAYGRFVAICRPLHYSTFMSKQVCLALMLGSYLAGLVSLVAHTTLTFSLSYCGSNIINHFFCEIPPLLALSCSDTYISEILLFSLCGFIEFSTILIIFISYTFILVAIIRMRSAEGRLKAFSTCGSHLTGITLFYGTVMFMYLRPTSSYSLDQDKWASVFYTVIIPMLNPLIYSLRNKDVKAAFKKLIGKKSQ

SEQ ID NO: 273 - protein, 314 aa, Artificial sequence
  synthetic
MEFTDRNYTLVTEFILLGFPTRPELQIVLFLMFLTLYAIILIGNIGLMLLIRIDPHLQTPMYFFLSNLSFVDLCYFSDIVPKMLVNFLSENKSISYYGCALQFYFFCTFADTESFILAAMAYDRYVAICNPLLYTVVMSRGICMRLIVLSYLGGNMSSLVHTSFAFILKYCDKNVINHFFCDLPPLLKLSCTDTTINEWLLSTYGSSVEIICFIIIIISYFFILLSVLKIRSFSGRKKTFSTCASHLTSVTIYQGTLLFIYSRPSYLYSPNTDKIISVFYTIFIPVLNPLIYSLRNKDVKDAAEKVLRSKVDSS

SEQ ID NO: 274 - protein, 318 aa, Artificial sequence
  synthetic
MKNVTEVTLFVLKGFTDNLELQTIFFFLFLAIYLFTLMGNLGLILVVIRDSQLHKPMYYFLSMLSSVDACYSSVITPNMLVDFTTKNKVISFLGCVAQVFLACSFGTTECFLLAAMAYDRYVAIYNPLLYSVSMSPRVYMPLINASYVAGILHATIHTVATFSLSFCGANEIRRVFCDIPPLLAISYSDTHTNQLLLFYFVGSIELVTILIVLISYGLILLAILKMYSAEGRRKVFSTCGAHLTGVSIYYGTILFMYVRPSSSYASDHDMIVSIFYTIVIPLLNPVIYSLRNKDVKDSMKKMFGKNQVINKVYFHTKK

SEQ ID NO: 275 - protein, 340 aa, Artificial sequence
  synthetic
MDSTFTGYNLYNLQVKTEMDKLSSGLDIYRNPLKNKTEVTMFILTGFTDDFELQVFLFLLFFAIYLFTLIGNLGLVVLVIEDSWLHNPMYYFLSVLSFLDACYSTVVTPKMLVNFLAKNKSISFIGCATQMLLFVTFGTTECFLLAAMAYDHYVAIYNPLLYSVSMSPRVYVPLITASYVAGILHATIHIVATFSLSFCGSNEIRHVFCDMPPLLAISCSDTHTNQLLLFYFVGSIEIVTILIVLISCDFILLSILKMHSAKGRQKAFSTCGSHLTGVTIYHGTILVSYMRPSSSYASDHDIIVSIFYTIVIPKLNPIIYSLRNKEVKKAVKKMLKLVYK

SEQ ID NO: 276 - protein, 319 aa, Artificial sequence [sequence omitted]

SEQ ID NO: 277 - protein, 310 aa, Artificial sequence
  synthetic
MDWENCSSLTDFFLLGITNNPEMKVTLFAVFLAVYIINFSANLGMIVLIRMDYQLHTPMYFFLSHLSFCDLCYSTATGPKMLVDLLAKNKSIPFYGCALQFLVFCIFADSECLLLSVMAFDRYKAIINPLLYTVNMSSRVCYLLLTGVYLVGIADALIHMTLAFRLCFCGSNEINHFFCDIPPLLLLSRSDTQVNELVLFTVFGFIELSTISGVFISYCYIILSVLEIHSAEGRFKALSTCTSHLSAVAIFQGTLLFMYFRPSSSYSLDQDKMTSLFYTLVVPMLNPLIYSLRNKDVKEALKKLKNKILF

SEQ ID NO: 278 - protein, 324 aa, Artificial sequence
  synthetic
MLESNYTMPTEFLFVGFTDYLPLRVTLFLVFLLVYTLTMVGNILLIILVNINSSLQIPMYYFLSNLSFLDISCSTAITPKMLANFLASRKSISPYGCALQMFFFASFADAECLILAAMAYDRYAAICNPLLYTTLMSRRVCVCFIVLAYFSGSTTSLVHVCLTFRLSFCGSNIVNHFFCDIPPLLALSCTDTQINQLLLFALCSFIQTSTFVVIFISYFCILITVLSIKSSGGRSKTFSTCASHLIAVTLFYGALLFMYLQPTTSYSLDTDKVVAVFYTVVFPMFNPIIYSFRNKDVKNALKKLLERIGYSNEWYLNRLRIVNI

SEQ ID NO: 279 - protein, 312 aa, Artificial sequence
  synthetic
MADDNFTVVTEFILLGLTDHAELKAVLFVVFLVIYAITLLRNLGMILLIQITSKLHTPMYFLLSCLSFVDACYSSAIAPKMLVNLLVVKATISFSACMVQHLCFGVFITTEGFLLSVMAYDRYVAIVSPLLYTVAMSDRKCVELVTGSWIGGIVNTLIHTISLRRLSFCRLNAVSHFFCDIPSLLKLSCSDTSMNELLLLTFSGVIAMATFLTVIISYIFIAFASLRIHSASGRQQAFSTCASHLTAVTIFYGTLIFSYIQPSSQYFVEQEKVVSMFYTLGIPMLNLLIHSLRNKDVKEAVKRAIEMKHFLC

SEQ ID NO: 280 - protein, 314 aa, Artificial sequence
  synthetic
MTRKNYTSLTEFVLLGLADTLELQIILFLFFLVIYTLTVLGNLGMILLIRIDSQLHTPMYFFLANLSFVDVCNSTTITPKMLADLLSEKKTISFAGCFLQMYFFISLATTECILFGLMAYDRYAAICRPLLYSLIMSRTVYLKMAAGAFAAGLLNFMVNTSHVSSLSFCDSNVIHHFFCDSPPLFKLSCSDTILKESISSILAGVNIVGTLLVILSSYSYVLFSIFSMHSGEGRHRAFSTCASHLTAIILFYATCIYTYLRPSSSYSLNQDKVASVFYTVVIPMLNPLIYSLRSKEVKKALANVISRKRTSSFL

SEQ ID NO: 281 - protein, 311 aa, Artificial sequence
  synthetic
MKGANLSQGMEFELLGLTTDPQLQRLLFVVFLGMYTATLLGNLVMFLLIHVSATLHTPMYSLLKSLSFLDFCYSSTVVPQTLVNFLAKRKVISYFGCMTQMFFYAGFATSECYLIAAMAYDRYAAICNPLLYSTIMSPEVCASLIVGSYSAGFLNSLIHTGCIFSLKFCGAHVVTHFFCDGPPILSLSCVDTSLCEILLFIFAGFNLLSCTLTILISYFLILNTILKMSSAQGRFKAFSTCASHLTAICLFFGTTLFMYLRPRSSYSLTQDRTVAVIYTVVIPVLNPLMYSLRNKDVKKALIKVWGRKTME

SEQ ID NO: 282 - protein, 314 aa, Artificial sequence
  synthetic
MMASERNQSSTPTFILLGFSEYPEIQVPLFLVFLFVYTVTVVGNLGMIIIIRLNSKLHTIMCFFLSHLSLTDFCFSTVVTPKLLENLVVEYRTISFSGCIMQFCFACIFGVTETFMLAAMAYDRFVAVCKPLLYTTIMSQKLCALLVAGSYTWGIVCSLILTYFLLDLSFCESTFINNFICDHSVIVSASYSDPYISQRLCFIIAIFNEVSSLIIILTSYMLIFTTIMKMRSASGRQKTFSTCASHLTAITIFHGTILFLYCVPNPKTSSLIVTVASVFYTVAIPMLNPLIYSLRNKDINNMFEKLVVTKLIYH

SEQ ID NO: 283 - protein, 314 aa, Artificial sequence
  synthetic
MMMVLRNLSMEPTFALLGFTDYPKLQIPLFLVFLLMYVITVVGNLGMIIIIKINPKFHTPMYFFLSHLSFVDFCYSSIVTPKLLENLVMADKSIFYFSCMMQYFLSCTAVVTESFLLAVMAYDRFVAICNPLLYTVAMSQRLCALLVAGSYLWGMFGPLVLLCYALRLNFSGPNVINHFFCEYTALISVSGSDILIPHLLLFSFATFNEMCTLLIILTSYVFIFVTVLKIRSVSGRHKAFSTWASHLTSITIFHGTILFLYCVPNSKNSRQTVKVASVFYTVVNPMLNPLIYSLRNKDVKDAFWKLIHTQVPFH

SEQ ID NO: 284 - protein, 313 aa, Artificial sequence
  synthetic
MLLTDRNTSGTTFTLLGFSDYPELQVPLFLVFLAIYNVTVLGNIGLIVIIKINPKLHTPMYFFLSQLSFVDFCYSSIIAPKMLVNLVVKDRTISFLGCVVQFFFFCTFVVTESFLLAVMAYDRFVAICNPLLYTVNMSQKLCVLLVVGSYAWGVSCSLELTCSALKLCFHGFNTINHFFCEFSSLLSLSCSDTYINQWLLFFLATFNEISTLLIVLTSYAFIVVTILKMRSVSGRRKAFSTCASHLTAITIFHGTILFLYCVPNSKNSRHTVKVASVFYTVVIPMLNPLIYSLRNKDVKDTVTEILDTKVFSY

SEQ ID NO: 285 - protein, 328 aa, Artificial sequence
  synthetic
MFLTERNTTSEATFTLLGFSDYLELQIPLFFVFLAVYGFSVVGNLGMIVIIKINPKLHTPMYFFLNHLSFVDFCYSSIIAPMMLVNLVVEDRTISFSGCLVQFFFFCTFVVTELILFAVMAYDHFVAICNPLLYTVAISQKLCAMLVVVLYAWGVACSLTLACSALKLSFHGFNTINHFFCELSSLISLSYPDSYLSQLLLFTVATFNEISTLLIILTSYAFIIVTTLKMPSASGHRKVFSTCASHLTAITIFHGTILFLYCVPNSKNSRHTVKVASVFYTVVIPLLNPLIYSLRNKDVKDAIRKIINTKYFHIKHRHWYPFNFVIEQ

SEQ ID NO: 286 - protein, 311 aa, Artificial sequence
  synthetic
MGKENCTTVAEFILLGLSDVPELRVCLFLLFLLIYGVTLLANLGMIALIQVSSRLHTPMYFFLSHLSSVDFCYSSIIVPKMLANIFNKDKAISFLGCMVQFYLFCTCVVTEVFLLAVMAYDRFVAICNPLLYTVTMSWKVRVELASCCYFCGTVCSLIHLCLALRIPFYRSNVINHFFCDLPPVLSLACSDITVNETLLFLVATLNESVTIMIILTSYLLILTTILKMGSAEGRHKAFSTCASHLTAITVFHGTVLSIYCRPSSGNSGDADKVATVFYTVVIPMLNSVIYSLRNKDVKEALRKVMGSKIHS

SEQ ID NO: 287 - protein, 311 aa, Artificial sequence
  synthetic
MGKENCTTVAEFILLGLSDVPELRVCLFLLFLLIYGVTLLANLGMTALIQVSSRLHTPVYFFLSHLSFVDFCYSSIIVPKMLANIFNKDKAISFLGCMVQFYLFCTCGVTEVFLLAVMAYDRFVAICNPLLYMVTMSQKLRVELTSCCYFCGTVCSLIHSSLALRILFYRSNVINHFFCDLPPLLSLACSDVTVNETLLFLVATLNESVTIMIILTSYLLILTTILKIHSAESRHKAFSTCASHLTAITVSHGTILYIYCRPSSGNSGDVDKVATVFYTVVIPMLNPLIYSLRNKDVNKALRKVMGSKIHS

SEQ ID NO: 288 - protein, 324 aa, Artificial sequence
  synthetic
MAEVNIIYVTVFILKGITNRPELQAPCFGVFLVIYLVTVLGNLGLITLIKIDTRLHTPMYYFLSHLAFVDLCYSSAITPKMMVNFVVERNTIPFHACATQLGCFLTFMITECFLLASMAYDCYVAICSPLHYSTLMSRRVCIQLVAVPYIYSFLVALFHTVITFRLTYCGPNLINHFYCDDLPFLALSCSDTHMKEILIFAFAGFDMISSSSIVLTSYIFIIAAILRIRSTQGQHKAISTCGSHMVTVTIFYGTLIFMYLQPKSNHSLDTDKMASVFYTVVIPMLNPLIYSLRNKEVKDASKKALDKGCENLQILTFLKIRKLY

SEQ ID NO: 289 - protein, 311 aa, Artificial sequence
  synthetic
MTGGGNITEITYFILLGFSDFPRIIKVLFTIFLVIYITSLAWNLSLIVLIRMDSHLHTPMYFFLSNLSFIDVCYISSTVPKMLSNLLQEQQTITFVGCIIQYFIFSTMGLSESCLMTAMAYDRYAAICNPLLYSSIMSPTLCVWMVLGAYMTGLTASLFQIGALLQLHFCGSNVIRHFFCDMPQLLILSCTDTFFVQVMTAILTMFFGIASALVIMISYGYIGISIMKITSAKGRSKAFNTCASHLTAVSLFYTSGIFVYLSSSSGGSSSFDRFASVFYTVVIPMLNPLIYSLRNKEIKDALKRLQKRKCC

SEQ ID NO: 290 - protein, 324 aa, Artificial sequence
  synthetic
MAVGRNNTIVTKFILLGLSDHPQMKIFLFMLFLGLYLLTLAWNLSLIALIKMDSHLHMPMYFFLSNLSFLDICYVSSTAPKMLSDIITEQKTISFVGCATQYFVFCGMGLTECFLLAAMAYDRYAAICNPLLYTVLISHTLCLKMVVGAYVGGFLSSFIETYSVYQHDFCGPYMINHFFCDLPPVLALSCSDTFTSEVVTFIVSVVVGIVSVLVVLISYGYIVAAVVKISSATGRTKAFSTCASHLTAVTLFYGSGFFMYMRPSSSYSLNRDKVVSIFYALVIPVVNPIIYSFRNKEIKNAMRKAMERDPGISHGGPFIFMTLG

SEQ ID NO: 291 - protein, 315 aa, Artificial sequence
  synthetic
MSITKAWNSSSVTMFILLGFTDHPELQALLFVTFLGIYLTTLAWNLALIFLIRGDTHLHTPMYFFLSNLSFIDICYSSAVAPNMLTDFFWEQKTISFVGCAAQFFFFVGMGLSECLLLTAMAYDRYAAISSPLLYPTIMTQGLCTRMVVGAYVGGFLSSLIQASSIFRLHFCGPNIINHFFCDLPPVLALSCSDTFLSQVVNFLVVVTVGGTSFLQLLISYGYIVSAVLKIPSAEGRWKACNTCASHLMVVTLLFGTALFVYLRPSSSYLLGRDKVVSVFYSLVIPMLNPLIYSLRNKEIKDALWKVLERKKVFS

SEQ ID NO: 292 - protein, 310 aa, Artificial sequence
  synthetic
MPNFTDVTEFTLLGLTCRQELQVLFFVVFLAVYMITLLGNIGMIILISISPQLQSPMYFFLSHLSFADVCFSSNVTPKMLENLLSETKTISYVGCLVQCYFFIAVVHVEVYILAVMAFDRYMAGCNPLLYGSKMSRTVCVRLISVPYVYGFSVSLICTLWTYGLYFCGNFEINHFYCADPPLIQIACGRVHIKEITMIVIAGINFTYSLSVVLISYTLIVVAVLRMRSADGRRKAFSTCGSHLTAVSMFYGTPIFMYLRRPTEESVEQGKMVAVFYTTVIPMLNPMIYSLRNKDVKEAVNKAITKTYVRQ

SEQ ID NO: 293 - protein, 307 aa, Artificial sequence
  synthetic
MLNFTDVTEFILLGLTSRREWQVLFFIIFLVVYIITMVGNIGMMVLIKVSPQLNNPMYFFLSHLSFVDVWFSSNVTPKMLENLLSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 294 - protein, 311 aa, Artificial sequence
  synthetic
MRRNCTLVTEFILLGLTSRRELQILLFTLFLAIYMVTVAGNLGMIVLIQANAWLHMPMYFFLSHLSFVDLCFSSNVTPKMLEIFLSEKKSISYPACLVQCYLFIALVHVEIYILAVMAFDRYMAICNPLLYGSRMSKSVCSFLITVPYVYGALTGLMETMWTYNLAFCGPNEINHFYCADPPLIKLACSDTYNKELSMFIVAGWNLSFSLFIICISYLYIFPAILKIRSTEGRQKAFSTCGSHLTAVTIFYATLFFMYLRPPSKESVEQGKMVAVFYTTVIPMLNLIIYSLRNKNVKEALIKELSMKIYFS

SEQ ID NO: 295 - protein, 305 aa, Artificial sequence
  synthetic
MSNTNGSAITEFILLGLTDCPELQSLLFVLFLVVYLVTLLGNLGMIMLMRLDSRLHTPMYFFLTNLAFVDLCYTSNATPQMSTNIVSEKTISFAGCFTQCYIFIALLLTEFYMLAAMAYDRYVAIYDPLRYSVKTSRRVCICLATFPYVYGFSDGLFQAILTFRLTFCRSSVINHFYCADPPLIKLSCSDTYVKEHAMFISAGFNLSSSLTIVLVSYAFILAAILRIKSAEGRHKAFSTCGSHMMAVTLFYGTLFCMYIRPPTDKTVEESKIIAVFYTFVSPVLNPLIYSLRNKDVKQALKNVLR

SEQ ID NO: 296 - protein, 315 aa, Artificial sequence
  synthetic
MLSPNHTIVTEFILLGLTDDPVLEKILFGVFLAIYLITLAGNLCMILLIRTNSQLQTPMYFFLGHLSFVDICYSSNVTPNMLHNFLSEQKTISYAGCFTQCLLFIALVITEFYFLASMALDRYVAICSPLHYSSRMSKNICISLVTVPYMYGFLNGLSQTLLTFHLSFCGSLEINHFYCADPPLIMLACSDTRVKKMAMFVVAGFTLSSSLFIILLSYLFIFAAIFRIRSAEGRHKAFSTCASHLTIVTLFYGTLFCMYVRPPSEKSVEESKIIAVFYTFLSPMLNPLIYSLRNRDVILAIQQMIRGKSFCKIAV

SEQ ID NO: 297 - protein, 315 aa, Artificial sequence
  synthetic
MFSPNHTIVTEFILLGLTDDPVLEKILFGVFLAIYLITLAGNLCMILLIRTNSHLQTPMYFFLGHLSFVDICYSSNVTPNMLHNFLSEQKTISYAGCFTQCLLFIALVITEFYILASMALDRYVAICSPLHYSSRMSKNICVCLVTIPYMYGFLSGFSQSLLTFHLSFCGSLEINHFYCADPPLIMLACSDTRVKKMAMFVVAGFNLSSSLFIILLSYLFIFAAIFRIRSAEGRHKAFSTCASHLTIVTLFYGTLFCMYVRPPSEKSVEESKITAVFYTFLSPMLNPLIYSLRNTDVILAMQQMIRGKSFHKIAV

SEQ ID NO: 298 - protein, 320 aa, Artificial sequence
  synthetic
MNSENLTRAAVAPAEFVLLGITNRWDLRVALFLTCLPVYLVSLLGNMGMALLIRMDARLHTPMYFFLANLSLLDACYSSAIGPKMLVDLLLPRATIPYTACALQMFVFAGLADTECCLLAAMAYDRYVAIRNPLLYTTAMSQRLCLALLGASGLGGAVSAFVHTTLTFRLSFCRSRKINSFFCDIPPLLAISCSDTSLNELLLFAICGFIQTATVLAITVSYGFIAGAVIHMRSVEGSRRAASTGGSHLTAVAMMYGTLIFMYLRPSSSYALDTDKMASVFYTLVIPSLNPLIYSLRNKEVKEALRQTWSRFHCPGQGSQ

SEQ ID NO: 299 - protein, 309 aa, Artificial sequence
  synthetic
MDISEGNKTLVTEFVLTGLTDRPWLHVLFFVVFLVVYLITMVGNLGLIVLIWNDPHLHMPMYLFLGGLAFSDACTSTSITPRMLVNFLDKTAMISLAECITQFYFFASSATTECFLLVMMAYDRYVAICNPLLYPVMMSNKLSAQLLSISYVIGFLHPLVHVSLLLRLTFCRFNIIHYFYCEILQLFKISCNGPSINALMIFIFGAFIQIPTLMTIIISYTRVLFDILKKKSEKGRSKAFSTCGAHLLSVSLYYGTLIFMYVRPASGLAEDQDKVYSLFYTIIIPLLNPFIYSLRNKKVMHALRRVIRK

SEQ ID NO: 300 - protein, 313 aa, Artificial sequence
  synthetic
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSFAISVTTECFLLATMAYDRYVAICKPLLYPAIMTNGLCIRLLILSYVGGILHALIHEGFLFRLTFCNSNIVHHIYCDTIPLSKISCTDSSINFLMVFIFSGSIQVFSIVTILVSYTFVLFAILKKKSDKGVRKAFSTCGAHLFSVSLYYGPLLFIYVGPASPQADDQDMVEPLFYTVIIPLLNPIIYSLRNKQVTVSFTKMLKKHVKVSY

SEQ ID NO: 301 - protein, 313 aa, Artificial sequence
  synthetic
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSIAIGVTTECFLLATMAYDRYVAICKPLLYPAIMTNGLCIRLLILSYIAGILHALIHEGFLFRLTFCNSNIVHHIYCDTIPLSKISCTDSSINFLMVFIFSGSIQVFSIVTILISYTFVLFTVLEKKSDKGVRKAFSTCGAHLFSVCLYYGPLLLMYVGPASPQADGQNMVEPLFYTVIIPLLNPIIYSLRNKQVIVSFIKMLKRNVKVSY

SEQ ID NO: 302 - protein, 310 aa, Artificial sequence
  synthetic
MEEENATLLTEFVLTGFLYQPQWKIPLFLAFLVIYLITIMGNLGLIAVIWKDPHLHIPMYLLLGNLAFVDALLSSSVTLKMLINFLAKSKMISLSECKIQLFSFAISVTTECFLLATMAYDRYVAICKPLLYPAIMTNGLCIRLLILSYVGGLLHALIHEGFLFRLTFCNSNIIQHFYCDIIPLLKISYTDSSINFLMVFIFAGSIQVFTIGTVLISYIFVLYTILKKKSVKGMRKAFSTCGAHLLSVSLYYGPLAFMYMGSASPQADDQDMMESLFYTVIVPLLNPMIYSLRNKQVIASFTKMFKRNDV

SEQ ID NO: 303 - protein, 309 aa, Artificial sequence
  synthetic
MEEENATLLTEFVLTGFLHQPDCKIPLFLAFLVIYLITIMGNLGLIVLIWKDPHLHIPMYLFLGSLAFVDASLSSTVTPKMLINFLAKSKMISLSECMVQFFSLVTTVTTECFLLATMAYDRYVAICKALLYPVIMTNELCIQLLVLSFIGGLLHALIHEAFSFRLTFCNSNIIQHFYCDIIPLLKISCTDSSINFLMVFIFAGSVQVFTIGTILISYTIILFTILEKKSIKGIRKAVSTCGAHLLSVSLYYGPLTFKYLGSASPQADDQDMMESLFYTVIVPLLNPMIYSLRNKQVIASFTKMFKSNV

SEQ ID NO: 304 - protein, 309 aa, Artificial sequence
  synthetic
MEQDNTTLLTEFVLTGLTYQPEWKMPLFLVFLVIYLITIVWNLGLIALIWNDPQLHIPMYFFLGSLAFVDAWISSTVTPKMLVNFLAKNRMISLSECMIQFFSFAFGGTTECFLLATMAYDRYVAICKPLLYPVIMNNSLCIRLLAFSFLGGFLHALIHEVLIFRLTFCNSNIIHHFYCDIIPLFMISCTDPSINFLMVFILSGSIQVFTIVTVLNSYTFALFTILKKKSVRGVRKAFSTCGAHLLSVSLYYGPLIFMYLRPASPQADDQDMIDSVFYTIIIPLLNPIIYSLRNKQVIDSFTKMVKRNV

SEQ ID NO: 305 - protein, 321 aa, Artificial sequence
  synthetic
MARENHSLAAEFILIGFTNYPELKTLLFVVFSAIYLVTMVGNLGLVALIYVERRLLTPMYIFLGNLALMDSCCSCAVTPKMLENFFSEDRIISLYECMAQFYFLCLAETTDCFLLATMAYDRYVAICHPLQYHTMMSKTLCIRMTTGAFKAGNLHSMIHVGLLLRLTFCRSNKIHHFFCDILPLYRLSCTDPSINELMIYIFSIPIQIFTIATVLISYLCILLTVFKMKSKEGRGKAFSTCASHFLSVSIFYICLLMYIGPSEEGDKDTPVAIFYAIVIPLLNPFIYSLRNKEVINVLKKIMRNYNILKQTCSIANLFLIY

SEQ ID NO: 306 - protein, 321 aa, Artificial sequence
  synthetic
MNKENHSLIAEFILTGFTYHPKLKTVLFVVFFAIYLITMVGNIGLVALIYIEQRLHTPMYIFLGNLVLMDSCCSSAITPKMLENFFSEDKRITLYECMAQFYFLCLAETTDCFLLAAMAYDCYVAICNPLQYHTMMSKTLCIQMTAGAYLAGNLHPMIEVEFLLRLTFCGSHQINHFFCDVLPLYRLSCINPYINELVLFILAGSIQIFTIVLVSYFYILFTIFTMKSKEGRGKALSTCASHFLSVSIFCDSLLFMYARPGAVNEGDKDIPVAIFYTLVIPLLNPFIYSLRNKEVINIMKKIMKKRKFCHILKQMSSPLAT

SEQ ID NO: 307 - protein, 308 aa, Artificial sequence
  synthetic
MAEENHTMKNEFILTGFTDHPELKTLLFVVFFAIYLITVVGNISLVALIFTHRRLHTPMYIFLGNLALVDSCCACAITPKMLENFFSENKRISLYECAVQFYFLCTVETADCFLLAAMAYDRYVAICNPLQYHIMMSKKLCIQMTTGAFIAGNLHSMIHVGLVFRLVFCGSNHINHFYCDILPLYRLSCVDPYINELVLFIFSGSVQVFTIGSVLISYLYILLTIFKMKSKEGRAKAFSTCASHFLSVSLFYGSLFFMYVRPNLLEEGDKDIPAAILFTIVVPLLNPFIYSLRNREVISVLRKILMKK

SEQ ID NO: 308 - protein, 316 aa, Artificial sequence
  synthetic
MVEENHTMKNEFILTGFTDHPELKTLLFVVFFAIYLITVVGNISLVALIFTHCRLHTPMYIFLGNLALVDSCCACAITPKMLENFFSEGKRISLYECAVQFYFLCTVETADCFLLAAVAYDRYVAICNPLQYHIMMSKKLCIQMTTGAFIAGNLHSMIHVGLVFRLVFCGLNHINHFYCDTLPLYRLSCVDPFINELVLFIFSGSVQVFTIGSVLISYLYILLTIFRMKSKEGRAKAFSTCASHFSSVSLFYGSIFFLYIRPNLLEEGGNDIPAAILFTIVVPLLNPFIYSLRNKEVISVLRKILLKIKSQGSVNK

SEQ ID NO: 309 - protein, 322 aa, Artificial sequence
  synthetic
MNSLKDGNHTALTGFILLGLTDDPILRVILFMIILSGNLSIIILIRISSQLHHPMYFFLSHLAFADMAYSSSVTPNMLVNFLVERNTVSYLGCAIQLGSAAFFATVECVLLAAMAYDRFVAICSPLLYSTKMSTQVSVQLLLVVYIAGFLIAVSYTTSFYFLLFCGPNQVNHFFCDFAPLLELSCSDISVSTVVLSFSSGSIIVVTVCVIAVCYIYILITILKMRSTEGHHKAFSTCTSHLTVVTLFYGTITFIYVMPNFSYSTDQNKVVSVLYTVVIPMLNPLIYSLRNKEIKGALKRELVRKILSHDACYFSRTSNNDIT

SEQ ID NO: 310 - protein, 311 aa, Artificial sequence
  synthetic
MGTGNDTTVVEFTLLGLSEDTTVCAILFLVFLGIYVVTLMGNISIIVLIRRSHHLHTPMYIFLCHLAFVDIGYSSSVTPVMLMSFLRKETSLPVAGCVAQLCSVVTFGTAECFLLAAMAYDRYVAICSPLLYSTCMSPGVCIILVGMSYLGGCVNAWTFIGCLLRLSFCGPNKVNHFFCDYSPLLKLACSHDFTFEIIPAISSGSIIVATVCVIAISYIYILITILKMHSTKGRHKAFSTCTSHLTAVTLFYGTITFIYVMPKSSYSTDQNKVVSVFYTVVIPMLNPLIYSLRNKEIKGALKRELRIKIFS

SEQ ID NO: 311 - protein, 309 aa, Artificial sequence
  synthetic
MTLGNSTEVTEFYLLGFGAQHEFWCILFIVFLLIYVTSIMGNSGIILLINTDSRFQTLTYFFLQHLAFVDICYTSAITPKMLQSFTEEKNLMLFQGCVIQFLVYATFATSDCYLLAMMAVDPYVAICKPLHYTVIMSRTVCIRLVAGSYIMGSINASVQTGFTCSLSFCKSNSINHFFCDVPPILALSCSNVDINIMLLVVFVGSNLIFTGLVVIFSYIYIMATILKMSSSAGRKKSFSTCASHLTAVTIFYGTLSYMYLQSHSNNSQENMKVAFIFYGTVIPMLNPLIYSLRNKEVKEALKVIGKKLF

SEQ ID NO: 312 - protein, 321 aa, Artificial sequence
  synthetic
MERKNQTAITEFIILGFSNLNELQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 313 - protein, 312 aa, Artificial sequence
  synthetic
MGNHTRVTEFILLGFPDDPELQVLLFLLLLLTYLLTLTGNLLIITLVLLDSHLHTPMYFFLRNLSFLEIWYTTVTIPKMLANILTGDKTISFNGCMTQLYFFIFLGCTEFFLLAAMSYDRYVAICKPLHYPTIMSSRLCTQLVLGSWVAGFLIILPPLILISQLPFCGSNVINHFFCDISPLLQLACTDTSLLELVDFLLAVVTLLVTLLLVILSYTYIIRTILRIPSAQGRKKAFSTCASHLTVVSIFYGSCIFMYVRPSAKESVNLNKGVAVLYTVVTPLLNPFIYTLRNKEVKQALKKTLKKIKFLSKK

SEQ ID NO: 314 - protein, 312 aa, Artificial sequence
  synthetic
MRNHTTVANFILLGLTDDPQLQVIIFLLLFFTYMLSITGNLTIITLTLLDLHLKTPMYFFLRNFSFLEVSFTTVYIPKFLVSMATGDKTISYNDCAAQLFFTILLGATEFFLLAAMSYERYVAICKPLHYTTIMSSRVCSLLVFASWMAGFLIIFPPLLMGLQLDFCAANTVDHFFCDVSPILQLSCTDTDIIELMMLLSAILTLLVTLVLVILSYTNIIRTILKIPSSQQRKKAFSTCSSHMVVVSISYGSCIFMYVKPSAKERVSLNKGIALLSTSVAPMLNPFIYTLRNKQVKDVFKHTVKKIELFSMK

SEQ ID NO: 315 - protein, 312 aa, Artificial sequence
  synthetic
MRNSTAVTDFILLGLTSDPQWQVVLFIFLLVTYMLSVTGNLIIITLTLSDPHLQTPMYFFLRNFSFLEISFTSVCIPRFLVTVVTGNRTISYNGCVAQLFFFIFLGVTEFYLLAAMSYDRCMAICKPLHYTIIMSTRVCTLLVFSSWLAGFLIIFPPVMLLLQLDFCASNVIDHFICDSSPMLQLSCTNTHFLELMAFFLAVVTLMVTLTLVILSYTNIIRTILKIPSMSQRKKAFSTCSSHMIVVSISYSSCIFMYIKTSARERVTLSKGVAVLNTSVAPLLNPFIYTLRNKQVKQAFKSMVQKMIFSLNK

SEQ ID NO: 316 - protein, 312 aa, Artificial sequence
  synthetic
MRNHTEITEFILLGLTDDPNFQVVIFVFLLITYMLSITGNLTLITITLLDSHLQTPMYFFLRNFSILEISFTTVSIPKFLGNIISGDKTISFNNCIVQLFFFILLGVTEFYLLAAMSYDRYVAICKPLHCLSIMNRRVCTLLVFTSWLVSFLIIFPALMLLLKLHYCRSNIIDHFTCDYFPLLQLACSDTKFLEVMGFSCAAFTLMFTLALIFLSYIYIIRTILRIPSTSQRTKAFSTCSSHMVVVSISYGSCIFMYIKPSAKDRVSLSKGVAILNTSVAPMMNPFIYSLRNQQVKQAFINMARKTVFFTST

SEQ ID NO: 317 - protein, 311 aa, Artificial sequence
  synthetic
MNHTMVTEFVLLGLSDDPDLQIVIFLFLFITYILSVTGNLTIITLTFVDSHLQTPMYFFLRNFSFLEISFTTVCIPRFLGAIITRNKTISYNNCAAQLFFFIFMGVTEFYILTAMSYDRYVAICKPLHYTSIMNRKLCTLLVLCAWLSGFLTIFPPLMLLLQLDYCASNVIDHFACDYFPLLQLSCSDTWLLEVIGFYFALVTLLFTLALVILSYMYIIRTILRIPSASQRKKAFSTCSSHMIVISISYGSCIFMYANPSAKEKASLTKGIAILNTSVAPMLNPFIYTLRNQQVKQAFKNVVHKVVFYANQ

SEQ ID NO: 318 - protein, 312 aa, Artificial sequence
  synthetic
MPNMTSIREFILLGFTDNPELQVVIFFFMLITYLLSVSGNMIIIMLTLSNIHLKTPMYFFLRNFSFLEISFTTVFIPRFLINIATGDTTISYNASMAQVFFLILLGSTEFFLLAVMSYDRYVAICKPLHYTTIMSNKVCNWLVISSWLAGFLIIFPPVIMGLQLDFCDSSTIDHFICDSSPMLLIACTDTQFLELMAFLLAVFTLMVTLALVVLSYTLILKTILKIPSAQQRKKAFSTCSSHMIVVSVSYGSCIFMCVKTSAKEGMALSKGVAVLNTSVAPMLNPFIYTLRNQQVKQALREFTKKILSLNKQ

SEQ ID NO: 319 - protein, 312 aa, Artificial sequence
  synthetic
MKNRTSVTDFILLGLTDNPQLQVVIFSFLFLTYVLSVTGNLTIISLTLLDSHLKTPMYFFLRNFSLEISFTSVCNPRFLISILTGDKSISYNACAAQLFFFIFLGSTEFFLLASMSYDCYVAICKPLHYTTIMSDRICYQLIISSWLAGFLVIFPPLAMGLQLDFCDSNVIDHFTCDSAPLLQISCTDTSTLELMSFILALFTLISTLILVILSYTYIIRTILRIPSAQQRKKAFSTCSSHVIVVSISYGSCIFMYVKTSAKEGVALTKGVAILNTSVAPMLNPFIYTLRNQQVKQAFKDVLRKISHKKKKH

SEQ ID NO: 320 - protein, 312 aa, Artificial sequence
  synthetic
MKNHTVIRTFILLGLTGDPHLQVLLFIFLFLTYMLSVTGNLTIITLTLVDHHLKTPMYFFLRNFSFLEVSFTTVCIPRFLYNISMGDNTITYNACASQIFFVILFGATEFFLLAAMSYDRYVAICKPLHYVVIMNNRVCTLLVLCCWVAGLMIIVPPLSLGLQLEFCDSNAIDHFSCDAGPLLKISCSDTWVIEQMVILMAVFALIITLVCVILSYLYIVRTILKFPSVQQRKKAFSTCSSHMIVVSIAYGSCIFIYIKPSAKDEVAINKGVSVLTTSVAPLLNPFIYTLRNKQVKQAFSDSIKRIAFLSKK

SEQ ID NO: 321 - protein, 312 aa, Artificial sequence
  synthetic
MRKHTAITTFILLGLTEDPQLQVLLFMFLFITYMLSVTGKLTIIALTMLDPHLKTPMYFFLQNLSFLEISFTATCVPRFLYSISTGNKIITYNACVIQLFFADLFGVTEFFLLATMSYDRYVAICKPLHYMAIMSNKVCKTMVICCWMAALMIILPPLSLGFHLEFCDSNVINHFGCDALPILKIPCSDTSLIEQMVVASAVLTFIITLVCVVLSYTYIIRTILKFPSVQQKKKAFSTCSSHITVVSITYGSCIFIYIKPSAKEEVNINKGVSVLISSISPMLNSFIYTLRNEQVKQAFHDSLKKIAFRLKK

SEQ ID NO: 322 - protein, 314 aa, Artificial sequence
  synthetic
MKNKSMEIEFILLGLTDDPQLQIVIFLFLFLNYTLSLMGNLIIIILTLLDPRLKTPMYFFLRNFSFLEVIFTTVCIPRFLITIVTRDKTISYNNCATQLFFILLPGVTEFYLLAAMSYDRYVAICKPLHYPIIMSSKVCYQLVLSSWVTGFLIIFPPLVMGLKLDFCASKTIDHFMCETSPILQISCTDTHVLELMSFTLAVVTLVVTLVLVILSYTCIIKTILKFSSAQQRNKAFSTCTSHMIVVSMTYGSCIFMYIKPSAKERVTVSKGVALLYTSIAPLLNPFIYTLRNQQVKEVFWDVLQKNLCFSKRPF

SEQ ID NO: 323 - protein, 312 aa, Artificial sequence
  synthetic
MKNHTRQIEFILLGLTDNSQLQIVIFLFLLLNCVLSMIGNFTIIALILLDSQLKTPMYFFLRNFSFLEISFTTACIPRFLITIVTREKTISCNGCISQLFFYIFLGVTEFFLLAALSYDRYVAICKPLRYMSIMSNKVCYQLVFSSWVTGFLIIFTPLILGLNLDFCASNIIDHFICDISLILQLSCSDTHLLELIAFLLAVMTLIVTLFLVILSYSYIIKTILKFPSAQQKKKAFSTCSSHMIVVSITYGSCMFIYIKPSANERVALSKGVTVLNTSVAPLLNPFIYTLRNQQVKQAFKAVFRKIFSASDK

SEQ ID NO: 324 - protein, 309 aa, Artificial sequence
  synthetic
MKNRTMFGEFILLGLTNQPELQVMIFIFLFLTYMLSILGNLTIITLTLLDPHLQTPMYFFLRNFSFLEISFTSIFIPRFLTSMTTGNKVISFAGCLTQYFFAIFLGATEFYLLASMSYDRYVAICKPLHYLTIMSSRVCIQLVFCSWLGGFLAILPPIILMTQVDFCVSNILNHYYCDYGPLVELACSDTSLLELMVILLAVVTLMVTLVLVTLSYTYIIRTILRIPSAQQRTKAFSTCSSHMIVISLSYGSCMFMYINPSAKEGGAFNKGIAVLITSVTPLLNPFIYTLRNQQVKQAFKDSVKKIVKL

SEQ ID NO: 325 - protein, 308 aa, Artificial sequence
  synthetic
MDTGNKTLPQDFLLLGFPGSQTLQLSLFMLFLVMYILTVSGNVAILMLVSTSHQLHTPMYFFLSNLSFLEIWYTTAAVPKALAILLGRSQTISFTSCLLQMYFVFSLGCTEYFLLAAMAYDRCLAICYPLHYGAIMSSLLSAQLALGSWVCGFVAIAVPTALISGLSFCGPRAINHFFCDIAPWIALACTNTQAVELVAFVIAVVVILSSCLITFVSYVYIISTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 326 - protein, 313 aa, Artificial sequence
  synthetic
MGNWSTVTEITLIAFPALLEIRISLFVVLVVTYTLTATGNITIISLIWIDHRLQTPMYFFLSNLSFLDILYTTVITPKLLACLLGEEKTISFAGCMIQTYFYFFLGTVEFILLAVMSFDRYMAICDPLHYTVIMNSRACLLLVLGCWVGAFLSVLFPTIVVTRLPYCRKEINHFFCDIAPLLQVACINTHLIEKINFLLSALVILSSLAFTTGSYVYIISTILRIPSTQGRQKAFSTCASHITVVSIAHGSNIFVYVRPNQNSSLDYDKVAAVLITVVTPLLNPFIYSLRNEKVQEVLRETVNRIMTLIQRKT

SEQ ID NO: 327 - protein, 347 aa, Artificial sequence
  synthetic
MGNWTAAVTEFVLLGFSLSREVELLLLVLLLPTFLLTLLGNLLIISTVLSCSRLHTPMYFFLCNLSILDILFTSVISPKVLANLGSRDKTISFAGCITQCYFYFFLGTVEFLLLTVMSYDRYATICCPLRYTTIMRPSVCIGTVVFSWVGGFLSVLFPTILISQLPFCGSNIINHFFCDSGPLLALACADTTAIELMDFMLSSMVILCCIVLVAYSYTYIILTIVRIPSASGRKKAFNTCASHLTIVIIPSGITVFIYVTPSQKEYLEINKIPLVLSSVVTPFLNPFIYTLRNDTVQGVLRDVWVRVRGVFEKRMRAVLRSRLSSNKDHQGRACSSPPCVYSVKLQC

SEQ ID NO: 328 - protein, 323 aa, Artificial sequence
  synthetic
MNPENWTQVTSFVLLGFPSSHLIQFLVFLGLMVTYIVTATGKLLIIVLSWIDQRLHIQMYFFLRNFSFLELLLVTVVVPKMLVVILTGDHTISFVSCIIQSYLYFFLGTTDFFLLAVMSLDRYLAICRPLRYETLMNGHVCSQLVLASWLAGFLWVLCPTVLMASLPFCGPNGIDHFFRDSWPLLRLSCGDTHLLKLVAFMLSTLVLLGSLALTSVSYACILATVLRAPTAAERRKAFSTCASHLTVVVIIYGSSIFLYIRMSEAQSKLLNKGASVLSCIITPLLNPFIFTLRNDKVQQALREALGWPRLTAVMKLRVTSQRK

SEQ ID NO: 329 - protein, 325 aa, Artificial sequence
  synthetic
MTTIILEVDNHTVTTRFILLGFPTRPAFQLLFFSIFLATYLLTLLENLLIILAIHSDGQLHKPMYFFLSHLSFLEMWYVTVISPKMLVDFLSHDKSISFNGCMTQLYFFVTFVCTEYILLAIMAFDRYVAICNPLRYPVIMTNQLCGTLAGGCWFCGLMTAMIKMVFIAQLHYCGMPQINHYFCDISPLLNVSCEDASQAEMVDFFLALMVIAIPLCVVVASYAAILATILRIPSAQGRQKAFSTCASHLTVVILFYSMTLFTYARPKLMYAYNSNKVVSVLYTVIVPLLNPIIYCLRNHEVKAALRKTIHCRGSGPQGNGAFSS

SEQ ID NO: 330 - protein, 317 aa, Artificial sequence
  synthetic
MRNLSGGHVEEFVLVGFPTTPPLQLLLFVLFFAIYLLTLLENALIVFTIWLAPSLHRPMYFFLGHLSFLELWYINVTIPRLLAAFLTQDGRVSYVGCMTQLYFFIALACTECVLLAVMAYDRYLAICGPLLYPSLMPSSLATRLAAASWGSGFFSSMMKLLFISQLSYCGPNIINHFFCDISPLLNLTCSDKEQAELVDFLLALVMILLPLLAVVSSYTAIIAAILRIPTSRGRHKAFSTCAAHLAVVVIYYSSTLFTYARPRAMYTFNHNKIISVLYTIIVPFFNPAIYCLRNKEVKEAFRKTVMGRCHYPRDVQD

SEQ ID NO: 331 - protein, 311 aa, Artificial sequence
  synthetic
MELENQTRVTKFILVGFPGSLSMRAAMFLIFLVAYILTVAENVIIILLVLQNRPLHKPMYFFLANLSFLETWYISVTVPKLLFSFWSVNNSISFTLCMIQLYFFIALMCTECVLLAAMAYDRYVAICRPLHYPTIMSHGLCFRLALGSWAIGFGISLAKIYFISCLSFCGPNVINHFFCDISPVLNLSCTDMSITELVDFILALVIFLFPLFITVLSYGCILATILCMPTGKQKAFSTCASHLVVVTIFYSAIIFMYARPRVIHAFNMNKIISIFYAIVTPSLNPFIYCLRNREVKEALKKLAYCQASRSD

SEQ ID NO: 332 - protein, 327 aa, Artificial sequence
  synthetic
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHIPSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 333 - protein, 312 aa, Artificial sequence
  synthetic
MSGENVTKVSTFILVGLPTAPGLQYLLFLLFLLTYLFVLVENLAIILIVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATILSYWHITLAVLRIPSATGCWRAFSTCASHLTVVTVFYTALLFMYVRPQAIDSQSSNKLISAVYTVVTPIINPLIYCLRNKEFKDALKKALGLGQTSH

SEQ ID NO: 334 - protein, 331 aa, Artificial sequence
  synthetic
MSGENVTRVGTFILVGFPTAPGLQYLLFLLFLLTYLFVLVENLAIILTVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATMLSYAHITLAVLRIPSATGCWRAFFTCASHLTVVTVFYTALLFMYVRPQAIDSRSSNKLISVLYTVITPILNPLIYCLRNKEFKNALKKAFGLTSCAVEGRLSSLLELHLQIHSQPL

SEQ ID NO: 335 - protein, 312 aa, Artificial sequence
  synthetic
MRNGTVITEFILLGFPVIQGLQTPLFIAIFLTYILTLAGNGLIIATVWAEPRLQIPMYFFLCNLSFLEIWYTTTVIPKLLGTFVVARTVICMSCCLLQAFFHFFVGTTEFLILTIMSFDRYLTICNPLHHPTIMTSKLCLQLALSSWVVGFTIVFCQTMLLIQLPFCGNNVISHFYCDVGPSLKAACIDTSILELLGVIATILVIPGSLLFNMISYIYILSAILRIPSATGHQKTFSTCASHLTVVSLLYGAVLFMYLRPTAHSSFKINKVVSVLNTILTPLLNPFIYTIRNKEVKGALRKAMTCPKTGHAK

SEQ ID NO: 336 - protein, 312 aa, Artificial sequence
  synthetic
MDTGNWSQVAEFIILGFPHLQGVQIYLFLLLLLIYLMTVLGNLLIFLVVCLDSRLHTPMYHFVSILSFSELGYTAATIPKMLANLLSEKKTISFSGCLLQIYFFHSLGATECYLLTAMAYDRYLAICRPLHYPTLMTPTLCAEIAIGCWLGGLAGPVVEISLISRLPFCGPNRIQHVFCDFPPVLSLACTDTSINVLVDFVINSCKILATFLLILCSYVQIICTVLRIPSAAGKRKAISTCASHFTVVLIFYGSILSMYVQLKKSYSLDYDQALAVVYSVLTPFLNPFIYSLRNKEIKEAVRRQLKRIGILA

SEQ ID NO: 337 - protein, 317 aa, Artificial sequence
  synthetic
MDQYNHSSLAEFVFLGFASVGYVRGWLFVLLLLAYLFTICGNMLIFSVIRLDAALHTPMYHFVSVLSFLELWYTATTIPKMLSNILSEKKTISFAGCLLQTYFFHSLGASECYLLTAMAYDRYLAICRPLHYPIIMTTTLCAKMAAACWTCGFLCPISEVILASQLPFCAYNEIQHIFCDFPPLLSLACKDTSANILVDFAINAFIILITFFFIMISYARIIGAVLKIKTASGRKKAFSTCASHLAVVLIFFGSIIFMYVRLKKSYSLTLDRTLAIVYSVLTPMVNPIIYSLRNKEIIKAIKRTIFQKGDKASLAHL

SEQ ID NO: 338 - protein, 324 aa, Artificial sequence
  synthetic
MESPNRTTIQEFIFSAFPYSWVKSVVCFVPLLFIYAFIVVGNLVIITVVQLNTHLHTPMYTFISALSFLEIWYTTATIPKMLSSLLSERSISFNGCLLQMYFFHSTGICEVCLLTVMAFDHYLAICSPLHYPSIMTPKLCTQLTLSCCVCGFITPLPEIAWISTLPFCGSNHLEHIFCDFLPVLRLACTDTRAIVMIQVVDVIHAVEIITAVMLIFMSYDGIVAVILRIHSAGGRRTAFSTCVSHFIVFSLFFGSVTLMYLRFSATYSLFWDIAIALAFAVLSPFFNPIIYSLRNKEIKEAIKKHIGQAKIFFSVRPGTSSKIF

SEQ ID NO: 339 - protein, 315 aa, Artificial sequence
  synthetic
MESGNQSTVTEFIFTGFPQLQDGSLLYFFPLLFIYTFIIIDNLLIFSAVRLDTHLHNPMYNFISIFSFLEIWYTTATIPKMLSNLISEKKAISMTGCILQMYFFHSLENSEGILLTTMAIDRYVAICNPLRYQMIMTPRLCAQLSAGSCLFGFLILLPEIVMISTLPFCGPNQIHQIFCDLVPVLSLACTDTSMILIEDVIHAVTIIITFLIIALSYVRIVTVILRIPSSEGRQKAFSTCAGHLMVFPIFFGSVSLMYLRFSDTYPPVLDTAIALMFTVLAPFFNPIIYSLRNKDMNNAIKKLFCLQKVLNKPGG

SEQ ID NO: 340 - protein, 319 aa, Artificial sequence
  synthetic
MTQLTASGNQTMVTEFLFSMFPHAHRGGLLFFIPLLLIYGFILTGNLIMFIVIQVGMALHTPLYFFISVLSFLEICYTTTTIPKMLSCLISEQKSISVAGCLLQMYFFHSLGITESCVLTAMAIDRYIAICNPLRYPTIMIPKLCIQLTVGSCFCGFLLVLPEIAWISTLPFCGSNQIHQIFCDFTPVLSLACTDTFLVVIVDAIHAAEIVASFLVIALSYIRIIIVILGMHSAEGHHKAFSTCAAHLAVFLLFFGSVAVMYLRFSATYSVFWDTAIAVTFVILAPFFNPIIYSLKNKDMKEAIGRLFHYQKRAGWAGK

SEQ ID NO: 341 - protein, 331 aa, Artificial sequence
  synthetic
MSPDGNHSSDPTEFVLAGLPNLNSARVELFSVFLLVYLLNLTGNVLIVGVVRADTRLQTPMYFFLGNLSCLEILLTSVIIPKMLSNFLSRQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTVITTFVTPLLNPFIYALRNEQVKEALKDMFRKVVAGVLGNLLLDKCLSEKAVK

SEQ ID NO: 342 - protein, 317 aa, Artificial sequence
  synthetic
MQPYTKNWTQVTEFVMMGFAGIHEAHLLFFILFLTMYLFTLVENLAIILVVGLDHRLRRPMYFFLTHLSCLEIWYTSVTVPKMLAGFIGVDGGKNISYADCLSQLFIFTFLGATECFLLAAMAYDRYVAICMPLHYGAFVSWGTCIRLAAACWLVGFLTPILPIYLLSQLTFYGPNVIDHFSCDASPLLALSCSDVTWKETVDFLVSLAVLLASSMVIAVSYGNIVWTLLHIRSAAERWKAFSTCAAHLTVVSLFYGTLFFMYVQTKVTSSINFNKVVSVFYSVVTPMLNPLIYSLRNKEVKGALGRVFSLNFWKGQ

SEQ ID NO: 343 - protein, 313 aa, Artificial sequence
  synthetic
MANLSQPSEFVLLGFSSFGELQALLYGPFLMLYLLAFMGNTIIIVMVIADTHLHTPMYFFLGNFSLLEILVTMTAVPRMLSDLLVPHKVITFTGCMVQFYFHFSLGSTSFLILTDMALDRFVAICHPLRYGTLMSRAMCVQLAGAAWAAPFLAMVPTVLSRAHLDYCHGDVINHFFCDNEPLLQLSCSDTRLLEFWDFLMALTFVLSSFLVTLISYGYIVTTVLRIPSASSCQKAFSTCGSHLTLVFIGYSSTIFLYVRPGKAHSVQVRKVVALVTSVLTPFLNPFILTFCNQTVKTVLQGQMQRLKGLCKAQ

SEQ ID NO: 344 - protein, 627 aa, Artificial sequence
  synthetic
MVDLVLSMMMLNLNQTEVTEFVLEGFSEHPGLRLFLTGCFLSLYMMALMGMMMLRLNQTEVTEFVLEGFSEHPDLRLFLIGCFLSLYMMALMGNILIIALVTFSTGLHNPMYFFLCNLATMDIICTSSVIPKALVGLVSEENTNIVIIALVTSSTGLHSPMYFFLCNLATMDIVCTSSVIPKALVGLVSGENTISFKGCMSQLFFLTWSASSELLLLTVMAYDRYVAICFPLHYSSRMSPQLCISFKGCMAQLFFLVWSASSELLLLTVMAYDRYVAICFPLHYSSRMSPQLCGALAMVVWFIGLVNACVHTGLMTRLSFCGPKVITHFFCEIPPLLLLSCSPGALAVGVWSICALNASVHTGLMTRLSFCGPKIITHFFCEIPPLLLLSCSPTYVNSILTLVADAFFVGINFMLTLLSYGCIIASILRMRSAEGKRKAFSTCTYINSVMTLVADAFYGGINFVLTLLSYGYIIGSILRMRSAEGKRKAFSTCSSHLIVVSVYYSSMFCAYISPASSYSPERSKVTSVLYSILSPTLNPLIYTSSHLIVVSVYYSSVFCAYVSPASSYSPERSKVSSVLYSVLSPTLNPIYTLRNDKLALGRILASFSHLRNKDKLALGRILPSFSH

What is claimed is:

1. A plasmid comprising a polynucleotide comprising a sequence which encodes a
    functional synthetic odorant receptor comprising an odorant receptor family consensus amino acid sequence comprising one of: SEQ ID Nos: 56, 144, 213, 93 and 117.

2. The plasmid of claim 1, further comprising heterologous nucleic acid encoding one or more of Receptor Transporting Protein 1 (RTP1), and Receptor Transporting Protein 2 (RTP2).

* * * * *